United States Patent 10,058,574 (COMPOSITIONS COMPRISING BACTERIAL STRAINS) - sequence listing, part 2

SEQ ID NO: 6 - DNA, 3937129 bp, Bacteroides coprocola (residues 1,968,566-3,937,129 of 3,937,129)
tacgcgtaccagtaccgcttcatccggttcaaattcgcccttaatcaaggcaacatgttccagtccgttacttttctgacggaacggtatcagacggaaatgtccgaattcggtcggcatatccacttctactcctttttctaccagcgattcctgcttcaaacgataagcaatcaaatctgcaattgaaatcagtttcaatccatattcatcggccattttacgaagttccggaaggcgggccatcgttccgtcttcgttcataacttccatcaatgcaccagccggatacaatcctgccagtttagccaaatcgatgcaagcttccgtatgtccggcacgacgcaatacgcccttatcctgtgcatacagcggattaatgtgtccgggacgtccgaatgtttccggtctggaagcaggatcggcaagtgcacgaatcgtagcggcacgatcggcagccgaaacgcccgtagtacatccttccagtttatcaaccgtaacggtaaacggagttcctaacattgatgtattgttcgcaacctgatgtggcaggtcaagttctttacaacgtgataaagtaataggagcacagagtactcctcttgcatgcttcaacataaagttgactttttcgggagtaatcaactccgcagcgataattaaatcgccttcgttttcacgatcttcatcgtcgacaacgactacgaattcacctctgcgaaaatcttcgattgcttcttcaacggtatccaatttgatcttgtccatagtgctattattgtaaatataattgttgatttcttatttgttctattatactttgattgtttttgataatcagtctcaaatctttatccagccgaatccggtatcgccagatattcagataaagcaataatccggcgggtatcacaatacccaacagcaagttcagccagcgattgtcgaacaggctcttatgtgctttaaccgacaggaagggataattgttcagcaagttcagcaaaacagcatctttggtattcgacagctcctcgataacagcctccatctttttattgatttcggcaatcgcgtcatcatgcttgttgttggtaaatatctgaacataattcggcattcccttcaggcggtgattctccaggtataccgtacagtcacggctgatctcttccagtatttctatatctttctggtattcgggagtatgaatgatgacttccttcttgaacagatgtctggactgacgtattccaaacaacttgcggaagaaagcagcatatacatctatattaaacaccaccgaatctttattcgatttatacgtaaagaaagctcccaatggtgccagtacgatagtactcatccacgtacccaaaacaatattcatttcaccgctcttggctacacgagtggctccggagtcgatgatataataaatcacgaaaatcaataccgaaataacaaccggcattcctagtccaccttttcgaataatggcccccaaaggagctccgataaagaagaatataatacatgccaatgacagcgtaatcttcttatgccagtcggaacggtgtgaacggatattattatcggtatctttggtaaggaaactcttcatatcccagtccgaagccagtgaactcatccggttaccggtcgttgtcaataccttcagtttttcctgagaagtcatggagttatagatactatctgtattaataacagaaaccctctcttctttcattttggtagaatccgccggagtcaaaaccggagttcggtaggtagtagacataatatcggaatacatcgaccgtcccacactatcggcatgaacagtcagtgaatctattgcgaccgatatctcatgcatattcttgatatcggaacgacggtccaagaaactgccgtctaccatattaaactctgaactgaactttatcagcgtatgcttctctttgaatgtttcccgacgatacggtacattacgtgaaatgacagactgcgatttcaagttctcgaattgttctccattatacaaatgaagaaacaaatgttgcttatcggctgtcagttccagtttaccttctgccgcccaaatgatatgggcattttcaaagccatccgagaaattatagataagcacatccttcagcatacctgtcttacggtctttctgcttcacataaatgttatatccatcgatatcactataaaagacaccttcgggtatatctacttcgggagatttctgcttcatagaaaccagtaaagtccataattgtttctgtgcccttggtccgataatattctgaaagaagaatgacatacctcccagaaaaacacagaacagaacgaccggccggataatacgcaacagtggaattcccgccgctttcattgacaacaattcatatcgctctccgaaattaccaaaagtcatcaatgctgccagcaggatagctagaggaagagataaaggaatcaaagtcagaccagaatagaaaaagaactgtgcaagtacatttatttccaaccccttccctaccagttcatctacatatctccataagaactgcatcatgaagataaataaacagatgaaaaaagttcctgcaaagagcaataaaaagctcttcagcacaaatatatcaagtttttttatgcgtagcattccttatattatcattatagcgcacaaaagtagcataaaaaatggagaggagaacgatgttttatattatttttggaattacaccccacatattcttctcagaatttctatttgagaatcccataaatttttagtatcttcttcctcttcaggaacagtaaaatcagtaacttccaaggaatggtctttcgtcagctcattataatgtatttttaattcgaaatacgtccgtggctcttcgtcctcccaatggaaacgaataaaagattcggtacgcaaattaaggacctccgcattgcgagtttcggttttcccccatttgaacgtataagtcttatccactttcgacacattatcagcaaaccatctttgcaaaccagaaggagtactgatagctccccaaagaatagttccagaagcaggatttaaaggatattcgatacgtattttctttttcatagatttcattctcttacaattttaagatattaagcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgattaagataacggcgacaaaataaaccatttttttgtatactacataatgaatcgtatttttttactaatcaaccttagaatatcttcaacagaaaaataaaaatagagtaaaacgaaaaaaaactgtgttatgtattgcacaattaaaaaacttaacttacctttgcacccgcaaacgaaaaacaaatggcgggatagctcagctggttagagcgcatgattcataatcatgaggtccccggttcaatcccgggtcccgctacgagaaaaatttgcaacaatatttttataaaatgatggcgggatagctcagctggttagagcgcatgattcataatcatgaggtccccggttcaatcccgggtcccgctacaaagtttaaaagcttagatataaggcatttgggaggcttccactcctgggtgtcttttttgtttatataacctttgctgatcttacattagcctgaaaaggtaagataaaaatttccgaacaacatgctcagcacaggatatacgacaaaagggataatcgacccatcggtgactatccctttcttcacaaattagaaagattatttagaggttgttttggggtaggtactatttattaaatctctttcggcaatagaacgtaagaaaactcaaaagaaatctgaacaactatgttaaaatcaaaaagtcaaaaacaacatccctatataatcctctcatttgatatcatcataagctgcaatagctttttcaaaacgtccatttacatcctcgaaagaatacagcccgtcagcattcaacttcaagcccttcaactgtaactgatagaccataggagaatgatctaaatcaagcatttcaatatttctcaattgctcggttgtctgatacaccagatttatagcaacaaactcattccccgatttatctatccatttctcgaaaaccagcttactgccgataggtgtcttcttttctatggaagaaggcaattcataatcctcaacttccaatgcagcattcacacttgcaatattcgaatcgtgtccgcataagaaagtaaacttacgcacatcggaattaagttcatcattcatatagaccagcaacgggtgagccacattatatgcaacaacaggtgcggtaaacaatacatctccgtacacatcctttatacgggcaattttctcccaatccgaaatagagatatcgtgaccgaatgcagctttctgtgcatctgcttcctcataatactgtaagatgaaagcatcggaagccgaattggcaagcttcaaggcacccttcatggcaggctcctctcccttcttcaggataatctgtgtatcataatcatcgaaagcacaagtttctccagacttacaggcaggagagtccttcaagtcaagtacatcagcgataatgcggtatgaatcttcaagcccctcattaatacctcgtatccctttcttgcctcccattgcggcgatctgattcatggcgtcggaacaaaatgcctcacttaccttcgtcagacgagggaaaaagactggatccatcttactgggagcataccgatggcgaatagcaacattggctaccggcataaaacccgatgaaaaatactgagcagtcgctatggtacgttgcatactattagcgtaaaaattcacttcatcggcattgggcacataattttcggtaaacagtccttcactgaccagccatttacgaaagaattgtcccatcatggtttccagcaccccgccacgcaatgtcagttcactggaagcggcactccagtttgtccagcgatgaggagtcagtttacccaaagtacttccattatccgacaagggagaacggatattatgccgactcaatataaccacttcctttaaggtatacttttccttaaattcaggagagcgtttggtttgtgcccacacaaacgatgggcacacaaacattaagagcaacaatgacaaattagttacacttctcatatcattaatattttaaaagtcatcagtttcaaacctgtcggaaacgtacatttccatcaatcagaacttaatctgcaaacgcgtttcaataagtcctaattttgtattcggcgtattgatacggtctgttgtagttgtgtacgaaccacgtacacgccagatcatatacttattgatataatagttgaatgtagccgaccagtcattcagtctacctcccagcacctcagccttatgatcggacatatccgtatagttgtacgaaagaacaacctccatagaacccggatcaggagttgcaataccaccatccaagttggcatacttataattcttaccttttaccaatgcacggattgtaccataagcaccactcgccttgtaacaaggtttgtccttccggttcacattcacgtaaaagtactgcgtttccagtcctacacgtcctattgcagcagtcagttcaggagtaaatttatacaacatcttagcatcatcaataacagcttcctgcgcaacaactttcgcgattcgtgtagggaaagtagtcgacaaggtatacgaatgatgactcagttccttatccgaactataacgaggtgtttcaaacgctcctgaaaggcccacatggaagatctttcccggctcgcaaaacggcttataaaccagtcgagtcatcatacccacaccttggtttcccagcttgtcagaagtcatcttcatggcatccgattccgtaaagaagctcagtgtacccaagaatttactccgtgtatgctgatacatcaagccaatcatacgtgaattattgaaagcctggttacttgccggttcctccattgaaattttgaaagaagagcttgtcgcactctgcaagccaaactgatggatgaaatagccggcacgcaaaaagtcggcagcttccttatcaaaattatattgaacaaacacatccttcatgttcacctttccgtatgcatatcccatatccacctttgctttccacgcgccatacgatgcactgaagcccactcgcatatcgggaatagcaaatccatcattaaatttatcatcctgtccgtcggctttaaaaaggcctccgtcgagcaatatacgtccggaaggtttaatctccagtttctcttcctgtgctttcgcaccacagatcatagttaagcctaaagtcaataaaagtaatcgtttcatagtatcaaattatagttaacctattcgttttacaggttggattttacaaggttaataagtctagtttagttttgtgatttttagaaattcaaggatttacaggttgagagcattagtttttgaagtcactttttgccacttgtcccttacttaccagttcagcaaattctttcttagccttctccagctgcttcataaagttttcattcgcatgcagacgagccacaaccgcactggctaccagtcgggcagcatccacatcactctggaagtgatacccacagattacacgactttgtcccatttcgtatccgcgtttcaagatttcattttgtctgtccacattgatttcggcaagaacaagtgccgtagcccatccgatagctgtgtggccagaaggatacgaaccatttgtagaaagctcctgctgctgctctggattacatgtcatttcattgtaaaatgcaaacggacgcacacgcatataatgcactttcgcctcacgagttgccagatcaccggcatcctcacgcatacccaatactagcttatagatttcgggagtagtagttgccgaaatacgtacgccgaaagcttccgaaaacgcattgggcactccgtcaccatttacacgagcatcttctgccgcctgatcaccacgaggagtatttctctgcaactttccccatttatactgagcctcatcgttcataaacaaaatagagccgggttgtggcggagccggaagaagattcagactacttgccacttcatctgcacgcaagaaatacaagtccggatttgttcttacatctttaattttttcctgagcaaaagttgcaactgctactaaagacaaacatgcaacgaaaagacttcttttaatcataattctttaaagtttaaaaaggttatagattttttgatttcgatgctgcaaatgtatgccaaggctcccagacaaaaagttgcaaaagattatttcggcttacagcttaatgcaactttatacaaacatctgtaaataaacgaattacaacaagcaataaggtttaaataaaataagccgttcctgttgcagtgaactgcaatccacacataaaatatcccaaggacaaaaaataatattctgtaacgaacctcgcaccttacatagcaagcgatttcgaaacacagattgacagccgatggaacaacagcaaaaccctgtatcttacgcaacaaggttattctggttcctcaaaaaacaaaaagagtcatatctcactcccctacagaaagctcgatacaactcttttacacagtctgacagattctgcctgcctgaaggctggttatgcccctaccggacccaacctattctatcagacgcaagatataatagaccatactggtaggattagccttgacataatccctcagccactcatgattcgttttcaatttattatttaccagtcgactgatgaccggattcagatttccataaatacacaacattccgggaatatgcagacgtttgactttcggacaagcaatcagcaaagccaatactttggcaggctgattaccgaaattagaaaaatcgagtaccccactcagaatttccttatccgtcttcaccatattttcataaaaagccgtaacctgcttttcgatagactccgtaacccgacgcgtacattctgcaatctccaggctcagaccggtatcaaactttcgggtaatccgttcttcattttctctttccacccggttgcgtatggaagcatattcccccatcaacgaagcaatctcttccttaatgagcacctgcgaaacatgacagtccaccggatacagcaccttcagcaatttcacacgctccagtccttgcatttctctttgtatatgttccagctccgccagcagagcatcggtcactccatccgaatccatccgacgaagcctttcctgtttctcaaggatatattcatccacagctctcagcgcatcgtccgtaaagatataccgataacattcatcgaggcatgcaatatccgcctccagtgcggacaactccttgaccttcagattatccgtaagcgtatgcatcttgcgaaacaggcaaccattcaccttatctatacataccgtatcttccatatcgtgccagtaaagcgctatccgattcttcagaccagcaattgtctgaatccacttctcgtttttctctacctgcgccacaatattctccagattgtctgttgccagtgccatacgagattcttccagcaacgactccttttcaaagacatcatactcgcctaccgcctgcatctgcctttccagatacttggaaagtcccaatgcaatatcccggttcttcttcataatctgctccgacagagatctgatctgttctgccacaccgggagcatgtacatctataccgccgaataattctctcaaacggtcgacttcctttccatcgttttcgccggtaaagcgagccatggaagacaaactttccagcctgacaccgatatcatccaagtgcatttttactgcttttctcttactgcgcttccttctgaaatactccatgacaataatcagcatgacaaatacgacaaaagaaacgacaagcaacagaagctgaaggctcggcaccgacgattccatgtctacccattgggctgaagttctggaaaatgcccccattttcatgacaccaatattggaacccagatacaatgtatcgttcatcaccaaagaagccttcgggttaaaacgtatatcgtggaaatacctgccacgttccgtgatcccctccttgcccacaacatatttcaccagaccatattccggcaaggcatagagcaaagaatcatttaccctcaacagtttgttatatcctttcagcgatatggaatcattgtattctctgcacaccagccggtgattcgtgagaatcatcagcaaaggcttatgccctcctgtcaccgagatgtcacggataaacgtatgacgttccgtccccttaattggctgataagcatcgccctcactataaaataccccatcgttgagcgtagaaacatacaagtcgccggcacgaggagccagataaaaagcagtaatatacttattgtgcaagtcgtctaccagcatagattttccgtcagcgtctatccgcaccagatcatcttgaatgcccagataaatgcaactgccttctgcctccttcttcaagcaagcagccgttatcttggtaggcgactggtagagcacctgagaagaagcaaacaaaacgttgcttatgtatctccgctttatcttgatacgcttcagaacctgcttgttgctgatataatacagataccgcccgtctgccatcatacccgataccacttccccttcaggaatatccaatattttaaaagccacattgtcgcccgtacgttggcaatacaactcattcctggagtttacataataaatattggtaccatcggcgcacgatgccacaatttctccattggcattgaagatacccagatgaagcggaatattccacaaggcattctcagtaaccagaaccgtaaagccgtccaccttgtcggtagcaatgacattgttgcagaactgcggtacttttcgcctcagcggtaccgacaaaaacgatttcaggtcgtcactgagcaacaaatgattgtcatcgagaaaataatgaatgcttcccagcttataataaatacgaggcgaaaacttcagatctacttcatgcagcacattccctttcacatcctccacatacagtttctttcttgccagcagataaaccttgttatcgtataccgaaaccgtgtatacaggctctcctgcatgcgacaaagaaacttttccatcagtcagacttattctgaccagcccctcctgtgtagcacacaacaggcactttggtccataccgccgaatattgttcacaatgaacggcttgcccgaatgagcagtttcactatcctccgacggataaaccagcttcagttccttccctcccgagcgaggcatggagtaaagcccctgacttgttgcaacgtaaagcgattttccaacgagaagtatatcgtataccgaataattagtgcctttgtttggaatagcacaaatttcctccaaagaagtttcttcttcattcaacttccatttctgcaagccggaattacgtatccctacccagcataattttccgtccgccagtaccgagtcggtcacgaccttataaatacgatcggcaccaatattataactttgaaaactgcgctgcttcatgtaccatatatcaccagcttcgcttccgatccagaaagcagagtcaccatcggccgagatagaagaaagacgttcgttgaaatataactccgtttcacccagacttccggttttttcctgctcattacaaccgaaaaagactgacgccatacacaagaaagcaatataaaagaaaccgtttttcatatcattatcgtttggtatgcttgcaacaaaaaggttaacgacaacataatatatgtccgggagtagcccttaaaagcccacccggaaccagaatcagctggtccatctgcctcagttcttccggcagagaccagactcattctcatagctttatctgtttaatagttgaataacaaaaaaacagtataaaatgtttggaaaattctttccaatccttccatggaaaaagaaaaaacttctccccatccgaaaaaaaatcctcaggaaaccatacacaaaacataacgatatcttttcagattttgtacaaaacatgatgtcttttgtacaaaatcttagaaaatttgtacaaaaacagaaaaaagaagcagacaaattatcacacttatgcagaggttttcagctcccccctgcataagtcttttcttttcagcagcaaagacagccggaaacttctatacatctatttcttctggaagcaaatccgcctgaatattgttcatgctcccccacaaactataccgtgcttcagggttcatccgctccaacgagcgcagcacttccttcatatccgaacgatgagaatccttttcatacggacaattcttaatttgcttgcgataccccctgagttgtgccatttctatcaggtcggcttcatgtaccagacacatcggacggatgatcgtcatgtcgaacttccgcatcaccagacgcggcggcatggtactgaacgccccctgaaacgtcatgttcatcagcagcgtttccagaatgtcatccatgtgatgtcccaaggctatcttgttgcatccttgctccttggctaccgtaaagagcgccttccgacgattccaggaacaaagaaagcacggcgacttgcgggtgtctgtcgacggatcgaaagacgtttcgtaacgcacaaacggcacgcccagcccttcggcatacgcacgcaggtagtccatatccgattcgtatgcgatattcgtcatcaccacatgtgcggcaaccaccgaaaaacgaggcttgtagatacgcgaacggcgagccagcaactccagcaatgccagtgagtcctttcctcccgacagtcccaccagtatcttatcgccatcttctatcagtccatactgcataacccctttattgaaacgcttctcaatgcgtcgcatcaacttgtcttcttcagtcaattttcccatacattcattaaatcaaaaacggggataaaattacacgaaaagaacgattcccgaaagattttgaaaaatagaataccgaaatagacaaaatttcgaagaaacttcgtacttttgaaaatgacatattgaaacaacacgaaaaatatcatgaacaagaaatataccctagcccttatcggtttatgctgcatgggaagcgcttctgcacaatcgcttacccaagccaaagaatggtttctggaaggaaagttcgccgaagccaaacccgttttccagaaactggtaaaacaggcaccgtcgaacgccaattataatttctggtacggagcatgttgctacgaaacgggcgagctgcaggaagcactaccttatctggaaaaaagtgcagcccgcaaggtcatcaacgcttacttgtatttaggcaaactatattattcgatgtaccgtttcgacgaagcgacagaaaatctggaagaacatatagactggctggaaaagaaaaagcgtgatacgtccgaggccgaaaaagaactggaccgctgccgtcaggctgcccggatgctgcgcggtacggaaaatgtagccgtaatagacagcttcgtcgtagacaagaacgactttctttctgcctataaattaagcaaggaatcgggaacaatctcgaaaaccgaagacggttccggcacttcctttgtaaatgaactgggagataaaatgattttcacccaagcttctgccgatgatggagaaactcatttgtattcacgcatcaagctgattgacaaatgggaggatgcacaaccattggaagggctgagcgaaaccggacacaaccagaactatccgttcatggcttccgacggcattacactttattttggtgcggaaggtgacgaaagcatgggaggatatgatatttttgtaacccgctacgactcagacgacaacagttatctccgcccggacaacatcggtatgccgttcaactcgccttacaacgactacatgtatgcgctggacgacctgaacaatctgggatggtttgcttccgaccgttatcagccggaaggaaaagtctgcgtatatgtattcgttccgaacgaaaccaagcaggtatacgattatgaaaataccgacccgcagacgattatcgacgtagccagtctgagagaaataaagaaaacctggagcgacgacaataaggtacgcattgccaaacagcatctggctcaggtgatgtacggcgagaatacggaaaagaagaaaggagatttccgtttcgtagtagacgacaacgcggtttaccataccctgtccgacttccgttccaaggaagcacgccagatgtatgcttctctcctgcaaaaagaaaaagaccttgcctcgctggaagcatcgctggaaaatctgcgtacggcctatcagcagagcaacaaggcaggaaaagaaaaacttactcccggcattctcgacaaagaaaaacgcaccaacgaactgcgtcatgaactggaagagctgactttctctgtacgtaatgccgaactgaaagcactgaaacagtaaacaagcattgacataaccaatacgaactatatggaaatactgattatcattgcacttatcgtagcagggcttctgctctttgccgtagaagtctttctcgttcccggcattacccttgcaggtattgcatcgggggtcagtctgctctacgccatctactacgcgtttcatgctgtaggcacgcaggcaggattcattacacttgccgttgttgcagtcggaataatcggtgttaccatctggttcatgcgttccaagaccgtagaccgcctgtcgctcaagaaaacactcgactacaagcctgagcccctgaaaggaacaaacattcaggtgggcgacacaggtacgtcgctgacacgccttacactgataggaaacgcagaaataaacggacacattgtcgaggtacagtcggccgacggattcatcgaagaacggacttccgtacgcgtaacccgtatagacaacagcaccgtgtatgtagtacgctgcaaccagcagtaatctttaaccttaaataccctttttatctatgattgattcgatttatctcccgttcattctggctattggagcggtcatcctactggccgtatttttccactatgtgcctttctttctgtggctttcagccaaagtttcgggcgtacgtatctcgctcgttcagctttttctgatgcgtatacgtaatgttccgccttacgttatcgtaccggctatgatagaagcccacaaggcaggactgagcaccattacccgcgatgaactggaagcccactatatggcaggcggacatgtagaaaaggtagtacacgcactggtatcggcctcaaaagccaatatcgacctgtcattccagatggctacgggcatcgaccttgccggacgcgatgtattcgaagccgtgcagatgtctgtcaacccgaaagtcatcgacacacctcccgtaacggcagttgccaaagatggtatccagctcattgccaaggcacgtgtaaccgtacgcgccaacatccgccagctggtgggtggtgccggcgaagacactgttctggcacgtgtaggcgaaggtatcgtttcatccatcggttcgtctgaaaaccacaagtcggtactcgaaaaccccgactccatatccaagctggtactgcgtaagggactggatgcaggtacagctttcgaaattctgtccatcgatattgccgacatcgacatcggccgcaacatcggagcctccttgcaaatagatcaggcaaatgccgataaaaatatcgcacaggcaaaagccgaggaacgccgcgccatggcggttgccctggagcaagaaatgaaagccaaggcagaagaagcccgcgccaacgtgatacaggcagaagccgaagttccaaaagcaatggcagaagccttccgcaacggcaatctgggtatcatggactattaccggatgaaaaacattcaggcagataccgatatgcgcagcagcattgcacgtcccgacgcaaatcctgcgggacatgagcctatcggcaaataaagcctcaacatttatcgtgaaactcaactgactaaacaaaaaaataacaatcttatgaaaaagtattttccaccctcagaactaattataaacgaagatggctctgtatttcacctccatgtgaaaccggaacacctggccgataaagtaattctcgtgggcgaccccggacgagtagctcttgtagcttctcacttcgagagcagagaatgtgaagtagaaagccgtgagtttcgtactgtaaccggtatgtataaaggaaaaagaattaccgttacgtctaccggaataggttgtgacaacatagatatcgtgatgaacgaactcgatgcgctggcaaacatcaatttccagacgcgtgaagaaaacgatactttccgccagctggaactggtacgcatcggtacttgtggtggcttacagccttatacccctgtaggaactttcatctgttccgaggtttcggtaggattcgacggcctcctgaacttttacgcaggcagaaatgccgtatgcgacttgccgatggaacgcgcacttctgaaccacttgggatggagtggcaatctttgtgcaccggcaccttatgtaatccatgccgacaaggaactggtagaacgtattgctggagcggatatggtacggggtgtcacggtagcctgtggcggattcttcggtccacaaggcagacagctccgtattccacttgccgaccctcaccagaacgaaaatatagaaaacttcgaatatcagggacatcgcatcacgaacttcgaaatggaaagttcggcgctggcaggtctggcacgtctgcaagggcacaaggctactaccgtctgcatggtgatagccaaccgtgtggctaaagaagccaatacgggttacaagaatcagatagacgacctgataaagattgtgctggaacgtatctgatagtcccagtgtatagtaaactgcctgaaacccttcctatcatcttacagaaggaacggcttcaggcatcgttaattcatcgcttcgggagatcaaatcaaaagtccgatggtatgctgtcaggctatcgttcagaaacgacttcagctttcgcctgatttatttcgaatgcaatacaacaaccattcgagtaaaacagaaataacacagaagaaagtttcctcgctctaatcagaagaatcagtaaaagacgtaacttctgaaaccaacaattatcattcaaaaaagaaaaatagtcgtaaaagatcaaacactcataccatagaaggacaatctagctacctcctgtaacatttaaacgcatattatcatttttatggaagcaagtttcaagcaagacaataaactaaacaaagcagaacgttatcaaacatttcttacacaattcactccgctcatagaaggagaaaagaacgaaatcagtgtactggccaatacctgcgccgctctgaaggaagcattcgactttttctgggtgggcttttatctggtacacaacagcgaacttcacttgggaccgtttcagggaagtgtagcctgctatcgtatcaaaaaaggacgcggagtatgcggcaccgcctggtcggaagcacagacgcaggtcgtacccgatgtagaccaatttccgggacacattgcatgcagttccctctcccgctcggaaatcgttgtcccgataatcaccaacggagaagtaaaaggtgtgctcgacatcgacagcgaccagctgaatacatttgatgaaaccgaccggatttatctcgaaaaagtagtcgccctcctcatccgagagctttacttcccgcaataatatcgtccaaacttttccggaaataagccgaaaaagccgtatctttgtgcgatttaaaaagcaagaaaatatcgtgaatatacaacaaacagaagatactatttgtgccattgctaccgctcaaggcggagccatcggcacgattcgcgtttcgggtgctcaggctatcaccatcaccgaccgtatttttacccctgcctcgggcaagccactggcagagcgtaaaccctatactctgactttcggtcacattctttcccccgaaggagaagtaatagacgaagtgctggtcagccttttccgggcccctcattcttataccggtgaaaactccgtagagatatcctgccacggctcgtcttacatcctgcaacaggtcatgcaactcctgatcaagaatggatgtcgcgcagccggaccgggtgaatatacccagcgtgcctttctgaacggcaagatggacttgagccaggcagaagccgtagccgacctgattgcctcaacctctgccgctacacaccgcatggctatgaaccagatgcgtggaggattcagtcgcgaactgtctgccttgagagaaaagctgcttcacctgacttctctcatggagctggagctggatttcagtgaccacgaagaactggagtttgccgaccgttcggaactggaagaaatagcccgccagatagagcaagtcatcagtcatctggtcgacaccttcagtgtcggcaacgcattaaaaaacggcgtaccagttgccatcgtgggagaaaccaatgcgggtaaatcgactttgctgaatgcgctactaaatgaagaacgagctatcgtaagtgacattcacggcaccacgcgcgatgtcatcgaagacaccatgaatttaggtggcatcaccttccgctttatcgatacagccgggatccgtgacacgaccgataccatcgaaaacttgggtatcgaacgcagttttcagaaactggagcaagcaaacattgtgctttgggtgatcgatgctacttgtgctgaggaacaatatcgtgaactggctgaaaagattcttccccgatgtgagggcaagcatctggtgattgttttaaataaatcggatctcttgccttcggataacgcttattcttcaagcagtgattctatgaatcaggatattatcggtggacagactggtactcccaacgttacggggctggagtcgacttcctctacccatcggatgtttccgaacctgcccgaagatacttgtgttatcttgctttccgccaaacaaaaagagggtatttctcaacttcagaagcaattggtggactttgctgccctacccgacctttcacaaaatgatgtggtggtaagcaatatccgtcactacgaagcgttgagccgtgcactggagagtattcatcgggtacaagacggtctggccatgcatctctccggtgacttggtgagtcaagatttacgtgaatgtcttttccacctggctgagatcgtgggcggagaaatcaccactgacgaggtgttgggaaatatatttaagcatttctgcatcggaaaataggaacaaaaagcaggatataaagaaaccataagcaaacagcaaagaaaccagcaagaagcaacagaaatacaggacaatccaaaaaatagcacaggaaaccttttattttacttttgccgtttttttacgatatttttgttgtagatttgttgctggaaaagaatcaagcaacaaaagcaacaacagaaatggaaaaatcaaaagaaccaatcagactccgacaaaggaaaatgccgacaggaatcacgtccctgtacctcgacatttacaccaacggaaggaggagctacgagtacctaaagctgtacctcgtaccagagaagacaaaagcagacagggacaagaaccgagagacgctgcgtctggcagaaacaatcaaggcgaaaagactggtagagttccacaacggagaatacggactgaaggacgcacagcttgaagaaaccaatttctgggactattacaaggacatgtgcgaaaaacgcagaggagaagaaacaagagggaactggggaaactggtactcggcaatgaagcacctccagaaatacgacccgaaaatagaacagcgcacgttcaaggacatcacgccaaaatggatagaaggattcagagagtacctgttgaacaaggcgtacgcattcggaaacgacgaacggaacagagtgaaggatgcaaggctgtccaacaattcctgcatttcatacttcaacaaattgcgtgcatgcatcaaccacgcatacgacaacggaattatcagaacaaacccactccgagggatagaatcaatccatgcggaagaaggcacgagaatgtaccttacaatcgaggagctgcagaagctggcagatacaccatgcgagaaggaaagcgtgagaaaggcgttcctcttttcctgcctaacaggactgcgaaggagcgacatccagaaaatgaaatggagtgaggtacagcagcagggagaattcacgagaatcatcttcaagcagaagaagaccaaaggacaggagtacctcgacattacaccacaggcagcagagctgatgggagaacggggcaaaccgacagacaacgtgttcgaggacttcggctcacccagcccgacaaacgagtgcatcaagcgatgggtactgcgtgcaggaatccagaaggagataaccttccattgcggacggcacacgttcgcaaccatgatgctggacatcggaacggacatctacaccgtgagcaagctgctcggacaccgagagttgagcacgacccagatctatgcaaaggtcatggacaaaaacaagcaaaatgcggttgcagctatccccaatatattcaaaaagaaggattaagccgtgttttgccacgtgtgcccttgttttctttgagtggaggaaacatacctccacggaaagaaaatcgattgtaggcgatatttgcctaaaataacggatatttacctgctacgtaccagctacggcgtaccaactacggtgcgccttttttttgtgccgtttacaggagcatctatatttgaaaacatagccccagaaccagtaagcagccaagacgcagaaatcccataatcggaaaccagaaacccgagccattcggtctggaacatgtcgctgctcaaattcttttccaagaagttcagattccaacgattgatgccgtacctatcggtaaacgtttttttgccacgaataacaccctgcgcctttagcatatacagagcctcgaagaaccgagagattattttttgacttccttcattttgcatagctcatcggattttttttgcgcatcacgaacacgagcatacaccgtctcattgcgctgggaaagacggacagcccacacttcctcaaggtttgagaaatcgattttttttgccccagaaagagcctgctggaaatcatgcagctcggcaggggtcataacaggaatgaaccgctccagctcatagattcggtcaacatgactgcggacagcagagcgaacggaatcaaacctaccatcaagcatgtcgccctcacctgtcaagaaccagcgagcgtttatttctgggaaagccttcacgacagccagaacaggaacaataccgaaatttacacctttgaggagtttcccgaggtactggggactccaacccataagcgcacaaaactcggtctgcacgcctccagttttatactggattatttgaagaagacgttcattcattgctttacaaactttttaccattttcatcagcagttccacctcgaggataaagcacgaaagaagaaccagagataatttttatataactactttcagacctgtttacaacctcaccgttttcattgtactcataaaaccaaagcaatggatctgagagagaagaaggacgagtaaccgagaagaaacaatcatcggacactttgaatttttcgtcgttgaaataagaaacaaccagagcattaccatgagcaacaaattcaccttcaagaacagaaaccatatttttaggttcagagaaaggagaaaacgtgagctcttccgtttcagtcgtattcgtgacaggctgatagaccgaaaacacaaagtgaccattcaaaacagacaaaacctcgctgaccacagggtcaatttctgattcagaaggcacatcgtcgccagaacaagataaaaacattacaggcaacaaaaacagatacaaaaattttttcattttgattagtatttagggattttacatgttttaccaaagagagagcttacacggcatctgcagagattgcacgaccgcccgtctgggcatccacttttttaagatcctcaatttgagaccgaagcatggaaatgagttcatccacctgccggtctcgagcagcaaggctttccgcttgagcctttacaacagcccaaacagaagcatcaaccaccacctccgaatgagacgacggatctggagaaccagacgccccagaaaattcactgaacggattattcaggaacatattaccctcaccagtaagaacccacgttgatgataagtttttatcaagtgagcaaaccttcccaataaaggattcagaaacaacctttgcagaagacatgacttgcgacatgtatgaagaagaataaccaaggcgagcagccaaatcattctggctctcaaccaaatcattaaaaatcaaccaatttacaaccttacgaagtcgagaatatacgttcataactattccaatttattttaagcaaagtaacaaaatcgaaagggaaagtaaaataaatcgccttttatcttgcattaaagggaagatttacttacctttgccctcggcattgagggaaaacccagtgtaaagatacgataatttaatcaaaatcgaaataaactgaacagaaaaataaaataaatcgaaataagatgaaagcaacaatcagagtcgacatgaacaaagcgatggcagcagccgaagcaatagcggacaacaggcgaatcgcaagagacctcgagcagacctacagcaacgaatgggaaacccgagaatttgactatgacgaggaagacgaaatggacgagcttctgagcagtattgagtaccagcttaacagcgcaggaataaatacagacgagtacataatcgaacaggaataacttaaaaacgaaatatgatggaacaaagaaagctaaaaacaccatgccagcaggaacgagagaaccgtgagaatgcacttcttctcgagtacaacgaactgatgtccgtccacgggcagaaggcaacagcggtcaacaccctgctcatgaacaagtacgggattcattcagtgagtacaatctacgcaatgctacgcagagcgaaacaaagacaacaggaggaaacaaacaatgaaagcaactgaaatctggaaaaacctgctgctgatagttttggcagcgttcgcagtttttgatttttgtctcatcgtcggagaagacacagaagggacatccatcggttattttttcatgatcaagatgctcgcaattttcgcagccatcggattctacaccatcgggaaggtgtgcaaggaaaaggagcttttcccgaagtggttcatcgacattttgaacaagcaggaggaacaagtatgagtctggacgaactgaaggaacagctcgacagaatagaacgagcctccatgattgcagcaaagaggattctgaacatcgaggaggtggcgtttcttacaggtttcaagaagaacaccatctacgagatgaccagcaaaggtttgataccgcactcaaaacaggctggaagattattcttcagcaaggacgagatagagggctggctgatgagcaacagaaccgccacacagcaggaactggaatccaaggcagccacatacatcgcaacacgcagataacagaaagcaacggggaaagcagtaagaccccacaaaaataaacagaaatggaacaacaaatcattcaagtgcagcaggcagagatgctgcaagcaatcaaccgcagtgaggtggacattcaagtagcaacagcaaagcagtacccacgagacatccaccgctcgctgaacaacatccagacaatcgcaaccatgagcgagaagacggcacaggactgcttctacgcactcaagaagggaggagacgtcatagagggagtttcagtcagactggcagaaatcatagcagggcaatggggtaacctccgagtacagaccagaatcatcggtaacgacgggaagaccattacagcacagggaatctgccacgacctcgagacgaactttgcaaccagcgtggaagtgaagcgcagaatcaccgacaagaacggtaagacctacagcgaggacatgcaggtcgtgacaggaaacgcagccagcgcaatcgcattcagaaacgcagtcttgaaggtagtgccgaaagccatcacggacaacgtgatacaggaaatcaagagggtcgcaatcggcaaatcgaaggatatcgagacaagcagaaagaacctcgtcgagtatttcggaaagctcggagtttccaaggcgcagattctggcatacctgcaggtatcacgcatggaggacataaccgcagaaatggtattccaactccgaggactggcgaacgcactcaaggaaggaacaaccaccctgcaggagaacttcacggacacccagagcgagagcaagagcatcgctgacaaggtacgccagaaatcggaggatgccaagaagaaggcagaagcagccgtagcagcagccacaaaaccagcagacagcaaacctgctgacaataaaccgcaggaagtgccagcgaacgtagacccagagacaggagaaatcattaacaaataacaaagaacatggaaacaatcattcaaatcaagcaggaaaacctgcaagagctttataagacactgaccaattacccgaccatttcaaaggaacaggtaatacacgagatgcacaaggcgttcggagagaaagcattcagaccacatgatgtacgagaacgagttaaaacatttgaggacgcttgccgtgaacttggagaaggacacaagttcttgaacgagtgggattcttggtcgggtagctgttcatcagacctcgcagcattcctcaaactccgcatcatctgcgcagcattgaacgaaggatgggagcctaaattcacggagaacgaagaacgatggtatccttggttctggcttttaacacaggacgaaataaacgaaatgaaagaagaggataagaccaaaaggcaactcagaatgataacaggcgaattcagaactgaatttgcgggtctcgtgtgtgcgtcttcgcattacgccccctcgattacgtatacgagcatcggctctcggctttgctttcagaacgaagcgttagcgaaatacgcaggaacacagtttatagacatttggaaagactttttattaatcagaaaataagaacagaaatggatttgaacaaagcaacagaagccataattgcatggcaggaagagaaagaagaccacagaagcgttctggtgatagcaattgaagaatcagaacctaacaacggtgcacagcagaccaacgcaaaggtctgcatacatggaaacaaggaaacaatgaccaaactgatgaaacactttctcaaaacaggacaatcatttgagatgcaggacatcctgctgcacacttttttagaatcgtacgtcgacatgatcaacgaccagaagaagaaaaccaataacaacaacgaaaacaaagaggaggaataaacaatggcaacaacaatcataagaccagcaaccagagaagaatggcttgaagtacgaaaagcaggaatcggttcaagcgaggtagcaacaatcgtagggctcaacccttgggagacaccataccagctgtggagaagaaagctcggaatggacgagccgaaacaggaaacattcgccatgaaagcaggacactacctcgaagacgcagtgtcccagttctggcaggacgagacaggacgagaggtcatcaaacgaagcgcaggcgactggatcatacaggacgcagagaagacattcctgcaggtttccccagaccgaacattctggctggcaggaaagaccaagagcaacgacaacaaaggtattctggaatgcaagaccacgcagatgtcaatcgacccagacgacataccgaagcactggttctgccagctccagtaccagctcggggtcgcaggactgacagaaggaagcctcgcatggttgagctcgggcagggagttcggatacaaggatatccagcttgtcccagacttttacgcatggctggaggaagaggtaaccaagttctggacagacaacgtcctcggaggagttgagccatcagcagtcagcgtaaaggacgtcctgctcaagtacaacaccagcgtaggcggaaagacaaaggaagtgaccgacgagatgttcaacgcataccaagacttgaagcaggtcaaggcagagctcgcacagatggaagagcgcaaagaagagctggagaccaagctgaaggcagcgttcgaagacgcagaagcaattacatacggtggagacatcatcgccacatggaagacatcaaaaccatcagagaagctcgacagcaaagcattgaaggctgcgcacccagagctggtaaaagagttcacggtacagacagcaggcacaagacgattcctgctaaaataagaaacggaggtaacaaatgattcagatcagcaatcaagacagggacttcatagttcggtacatcgaggagatgaaccagaacagaaggaacgagacaaaccgagactacaacctgcagagaatggcgaacaacatcgcaaaagaactcaagcggaaaaaaagtacggacagaaagtgattgtattgcaatcattgtgttacctttgagcgactgaaatacagaacacaacagagatggaaacaagaaattcaacaccgaacaagggtgggcatacgaaaggaagcccgacgcagctgtatgcgtagtcgacccttcatcggtgttttttcataaagcgactaacagacagcaatgataacattacgaagcaatcaaggagaagcgatagacaaggcgatagaatacttcaaccagaagaagccgaagccgtcgctgatagtcctgccgacagcttggggaaagagtattctgacagcctttgttgccaagaacaccaacgacaagctgctggtcatacagccaagcaaggagctcctcgagcagaactacgccaaatacacgaccctgtgcgagggattctcctttaacgcaggcatttattcagccagcttcaacagacgggaaatttgccagataacatacgccaccatcggaagcatcaagaacctcggggagacattcaagagatacggattcacgaaaatgctgattgatgaggctcacctttaccccagagaagcagacagcatgctgggcaagttcctcaaggattctggcataacacacgtcctcggcataacagccaccccaatcaagctacagacgaaccgagacatggacggatgcacttattcaaagctggtcatgcttaccagcaggagcaagaaagggaactttttcaaagacatcatccatgtaggacaggtacaggaaatggtcgcccttggattctggagcaggctgcagtaccagagcgcagactttgactcgaccctgctaaaattcaacaccagcaaaagcgagtacaccgaagagagcgtacagctggcatacgaagcaaacggaggagcgagccagatagtacaggcgttgaaccagaaccaagacaggaaacacattctggtctttgtcccgagcgttctggacgcagaacagctggcagccaaatacccgaacagcgcatacgttcacggacagcaagacaaaagagagcgagcagagaccatccagaagttcaagactggagaaatacgggccttgttcaacgtgcgagtattgagcacaggattcgactttacaggcatcgactgcatcatcctcggcataagcaccgccagcattgccctttactaccagatcatcggacgagcaacacgaatagacccgaacaagcaggacgcactaatcgtcgaccttggagggaacgtgaagcagttcggaagggtcgaggatatcagatttgagaagggaaagatgtggcgaatgttcggatctggaggaaagctgctgagcggaataccgatatccgaaataggtagctacacgaaggaggacacagaccgagtggacaacggctcctatttcaagaaaatcgaaatcatgccttttggcaaatacaagggacagaagatagacagcatcccgagcgactaccgcaggtggatgattcgctcattcagctggaacagcagaaacgaagacctgcgacaatcgattatagcaacactttaaaaaagaaaattatgtcaagaccgaaaagcaaaatagcagaatacttcccacatttcgcaaaaggagggagaaccatttacatactggagagcaaatatggcaacgatggatacgccttctggtttaaggttctggagctgctttgcgatacggagggacaggtttacgattgcaagaacccagctaactgggagtttttgacagcgaaaacccgagtgacaagcgaacaggcaaaagaaattcttgcaacattggcttcattggaagccattgacccagagctttggaatcaacgacaggtcatatgggtgcaaaatttggtaaacaatttatcgccactatacagcagacgaagcagcagctccccacagagaccagacctcgaatgtgatagcagcaaaaaaccagatgaagcggaatattgcgaacagaaaccagacgttaacgggcaaaatgatgacaaaaacccacaaagtaaagtaaaggagagtaaagaagagaaaagtaaagattctatcgccaaaacgccacgttttgactgcgagcgaatcgttgaactttggaatgagattatcaagaagccagctgtcgccaagctgacagacgacaggcgaaagaaggtcaaagcaagaatcgaggaatggaaggcgaagacacaagaagaagccgaagccaaggctcgtgagattttcacgaggatttcagaatccgacttcttgagcggaaggacaggaagctggaacgcaacgtttgactggctgttcagcaacgacaagaactggctcaaggtcatggaagggaactacgacaaccgaacatcccacaagcccaataaagccccaaattgcggagattcaagactgggtgcaggagaatacatcactgaagacggaaggcgcacctacggcacaggaaaggcaacaataccagcatacgcaccaccgagaccaagcgaaagatattcatgggacgcaggatctgaaaactggatactacaatgagaatgaattttgagaaatacggaattgaagtcccatacaggaagacttctggaaacgtgaaggttttctgccctcaatgcagaagccaacgccacgacaaaagagatagaagtctttccgtaaaccttgcaacagggatgttcaaatgccattactgcggtttccaaggatgcgcagcagaacaggacgaacaggaaaagcaaaagtggatggaacagcaatcatggtacagaccagtaccgattaagaaacagaagccagagtacaagaaaccgacccatacaggaaacagccagatgagccagaaagcactggcatggttcgcaggaagaggaatctcggaaaagacgctacgggagatgaaggtcacagagggacaggaatggatgccacagaagaacggaaaagccaacacggtgcagttcaactactacaaggacggagttctggttaacaccaagttcagaacaggcgacaagtgcttcaagctgtgctcgggagcagaactcctcccctacaacatcgacgcaatcaagggaacaaaggagtgcatcattaccgaaggagaaatggacgcattgagcttctgggagataggcagacacgacgtggtcagcgtaccaaacggggcgaacgcaaacctctcctacctcgacgactacatagaaacatactttgacgacaaggaaacaatctacatcgccagcgatacagacacaaagggaacaatgcttcgagacgagctcatgcgcaggtttggagcggaaagatgcagggtgctggagtacggagaaggatgcaaggacgcaaacgaacacctccagaagtacggaaagcagtcccttctggaatgcttgcagaacgcaccagaaacaaagctggaaggaatattcacggtgtcagactttgaacagagccttgatgcgatattcgaacacgggctgcagcagggagtaacaataggacacccgaactttgacaagctgtgcagttttgagacaaaacgattgtgcatcgtgacaggaatcccagccagcggaaagtccgaattcatcgacgaaatagcggaacggctgaacatcagatacgggtggcgtttcgcatacttcagcccagagaacgcacccctcgagtaccacgccagcaagctgatagagaagttcactggaaaacacttctccaagcaatacctcggatggggagagtacaagcacgtaaagaaccacatcgagaataacttcttttttatcagcccaaaggaagacttcaagctggaaacaattctggatcgtgcgaaattcctcgtcagaagaaaaggaatcaaggcactggtcatagacccgtacaacagactggagagcgaacagggaaacagaagcgagacgctatacatcagccaaacgctcgacaagctgacgaactttgcgcagagaaacgacattctgattatcctcatggcgcacccaaccaagctgccaaagaacaaggacggagttattgaagtaccgaccctgtatgatatcagcggttcggcaaactttttcaataaggcagatttcggaatcgtcgtgcaccgagaccgaatcaacaacacgacagaggtgcacgttcagaaggtgaagttcaagcacctcggagaatgcggaacagcaatcttcaaatacaacttgaacaacggaagatacgtcccatacaacggaagcaacgaggtcgactgggacaacaccaaccacctgctcgaaatggaaacaaaaaagatacagcaggctatggaggaatcgagacttgacttcggagaaacaacaccagaggacgatatgccgttctcgccagcagcatcagaagactgcccattttaacaggattagaaaataacagggaaaccgacaacatacaacaaaatgaacaaaaaaagagtttacatcagcctgccgattacaggatatgaattgcaggaacggaaagaatacgcaaaaagaaccgcatcaaaggttcaagagtacctaaccgaacaaggagcaaaagacttcgaagtgataacaccgtttgacatctgcccagaagaaggactgacctacgcacaatacatggcgagggacatcgaggttctgatggaatcccacctcgtgttcctgtgcgaaggctggtatcaaagcacagggtgcaggattgaacgattcatcgcagagaggatggaaatccccataatcagagaagcacaccatttcccaaccttaagagagccgatattcaaatgacagcaggaaaagcaaaggagtcaagatggaaagaatagccgacaaccagatatgcgtaaagataagcgtgagcagcgacaccagaaaaaccattgaagaagtggtttattacaggaacaggctgccgatggcgattgtggagaaatggcggtggtatttcgagtacctcgcagccagagtgaaggttagacacccatacaggagagtggagctggtggtcgtacaccagacccttctccaagggcaggaatacatcgagaagaagaccgcagacctcctgcgagcgaagcggtctcaattgaagcgaatccagaacgagaccatccacgacgatgacctcttcggatacaagaaagagcagcgttcctgcaagatagaaagcctgcaggaacagataaaaaggctggagcgtggagaggtggacttttacgtgccaccgacctacatcaaccgaataaaggaatggatttaaacagataacagaaatgatttgaagcctatgaacaaaataacatttgaaaaggcaaaagtaattctcgatgagattgatagagccaaaagcacacttgaaaaaatcagtaaaacagacagcatttactacaaaaccccagatatggacggaggatatacagaggggaaatttgtagcgttttacaacagagataacaaagaattaaagcaggctttaaccgagttcttcaacaggaagataagcgagatggaacaagaatttgaagcattataatcaacgaatatgaaaacaaagacctacgttttaacattatcgaaatttttcccaaagacacataaaagagctggggaagaaaccgaatttgagctaaagttcgtgttcggaggtacactggataaaaagcacactatacgggcgaattacaacctctggaaataccgaatagaagaagtacaggcaggaagggctgttttatcggtaaggcagtggacgggcatgccatacaggagcaaacaaatagagattgcaaggctaacagcagagaacggaataggaattcagaaacttaaaatgattgatttattcagaccgacaacgataaatggacgcaaagttgaattaccagagttggcagcaaacgacggattgacatacaacgactgggtagaatggttcagaaagtacaacttaagagaaccattggctatcatacactttacaagttttagatattaacaaaacaggaatcagaaatggaaacaaacaactacgaaagcataaaggaaaagctgaaaaagctgagtgcccttgcggaacgaggggtaaacggagaagccgagaacgcaaaacgagcaatcgagaggatctgtgcccagtacggcatcaagctcgaggacatactggattctaacacggtaaagacatacaggtttaagattggacgtggaaagctggacattaggctgttcgtccaatgctatgcgaagattacaggcgagaaagccatgaagtacaagcagtacacaagggacaccattacaaccgagctgaccccgttacaggcagccgaactgaacagcctgttccaatggcacaaggagaacttcaagaaggaaatggagcagatccagaaagacctcatggacgcatacgtatcgaaacatcgaatatacagagataaatcggaagatgaggacgaagaggaacaggaagagcttaccccagaggaaatgcatcgtttgtttaagatgatgcaattgaggggaacgttcagcgacagaacataccagaaacaacttgaaacaaagaacgattaaaaaacatacagaaatggaagtaggatacgcagacagaatcaaaagagagcttgcacatttggagagaacggctgtaacaaagaagcagcgcatcaaagccctaaagaggataaacgaaatcaagcgagagtacctgcagatgatggacgaggagaagaaggagaatgaatgcatcctccagattacggaacgcaaatgctccgagaaaatccagccagaaatcaaggtcgggaaacgatacctcatcaagggcagggaaaagctggcagacggaacggaagtggttgttctggtcaactgggaacgctccaagacagaaaagaagctcaagaccatgcgatgcaatgcgaagcgtttctcgtggagaaccgtgaccgaggagcaggcaaaagaggaatttctgaaggaggaagcaaagagaggagcagccgaactccttcatggtttcaacttcgaggaacacatgcagattgcgtttgtaccgctcatcatcatccattgcgcatgggcgtattgcgacaaggttctccaaatggcagcaaagctgcggataagcgaaacaaagaagctgggacgagccgtgaaggagctgaaacaggcttactacgacgagctgaagaaagacctcgactacaaacatttgaaacaggtttcagaccaagcggaagagttcatgaatacgtgcgcaaaagacttcatgattatggagttcacgattcgaggggaaatactgaaggtttacccagacgacccgtacatcgacatgagggtctacgcatttgcaagcgtcctgctttgcgattactacgtgaagcacagccacgaatgcgataagatgatagcagccagactgcatcgcagagagacccagacaatgacaaacccgaagatagattcactcagaacctgcatggatgcatacacaggaacggtggaaatcaatctcaagcaaaacgtggagctttgcgtcagagtatttgcgaacaacctcaaaaaaataaacttcacgctggatcacgagcaaagaatcggaattcagcaataaccaacaatataaattttttacaaacatggaaattacaggaagaataatcgcagcgtgcgaggtaaaaggcggaatctcgcagagaacaggaaatgcatggaaatcacaggaattcgtgctggagacacaggagcagtacccgaagaagtgcgtgtttaacgtgttcggagaagataagctgaacgcattcaacatccagataggcgaaaccctcaaagtgcagattgacatcgatgcaagggagtacaacggacgatggttcaacagcatcacggcatggaaggtggagagaccacaggcgcaggcacaggctccagccccacagcagccagcgtaccaacagccagcaccgcaacctgcataccagccagcagcgacgacgaatgacaaagacgacctcccgttctgaccagacccgaggacgtgaacaaccgaaggaggaggatgcatatatgcacctccccttcttgcgttttatgaataatcgaaaataaagccatatgacagcgaaaaaagaaaaacaggtacaaatacccacgaaagcaaagaaaagccagcagaagcaaaataacgcaccaaaatacgacctttttacggctttatgcagaagcgacctaaaggtggaatgcgtgaaggaaatgagattccacccgaaaaggatgtggaggtttgactacgcaatcccagaacacaggatagccatcgaagtggaaggcggtgtctggactggaggaagacacaccagaccgaaaggattcctcggggacatcgagaagtacaacacggcaaccgtaatgggctggagactgctccgaacaacaccagaagaactggtatcaaagaagaccgtagacatgataaaaaccatcatttctggcgagttttcgcacgaaaacagctgaaaacagccaaaaaagtgattgcaatacaatcattttgagtatttttgtgcaataacaaaacccctaacagcgaaaagaaatggcaaaacagcgaaaagaaatgcacgaaacagacccgatagtagacttcggagacatcggaaactttgatgtaccagacatcgatgcgtcccttgtcagctttatcccagcagatgaagccgaggagaccagatacacgaacccaaaggcagtccagcaggaaacggaacaggtgatgtttgacaacgcatgggaaatggcgaagggaataaccatagaccgaggacagcgtgtcgatgcgttcgtttctggaaacttcatattcggggacttcatcgaagcatttctggcaacaaggaacgccagagcaaaggaaatgacgatatccaccctttcactgaaccagaacaacatcgattcactggcagaactgatgcgctacaattacatcggaaagctgaacctcgtcgtttcggtttacttctggggcaacgaacggcactcgttgattccatacgcctacagggaactggacgtggacgaccgattccaactggctgtagcggatatccacaccaagaccgtgcacttcgagaccgagggaggaaagaaaatcgtcattcatggcagcgcaaaccttcgtagttcgggcaacatcgagcagttcacgctggaggagaacccagacctgtacgatttctacgaggaaaaattcaagctcctcatagcgaaatacgggactatacgccacgcaatcagagcaaaccaagcgtgggactacatcaacaggaaacaattcaagtaaccaaccagaaaggaggtaaatatggcaagtggaagcgaaagtcacagcagcggaagcaagataaagggctcaaccgcagcaaaggggcgtctctcctcctacgcaggagcgtggaatccgagcatgaacactccgttctgaacagagagatagcaccagacagccccacaaaggacaatgagccgaatgtggggcgtttacgattgaatttataaccaatacccaatattacacaggatggaaacgatattcattgatttggggcttatacaccccaatgacgggcagctggaaggactgccgaagaacccgaggttcatcagagacaacaaatacaagaagttagtccagagcatcaaggacgacccagaaatgctggagcttcgagaattgctcgtgtacgacacaggcgacccttcactccagtacatcatcgtcggtggaaatatgcgctacagggcaataaaagagctcggctacaccgaagcaccatgcaaggtcattcctacaggattctccatcgagaaaatgcgtcgcatcgtgctgaaggacaactccagcttcggggaaatggacttcgaagcactcatcaacgaatggagcatggaggaaatcgaatctgcagccatcgatgtgccagacattgaagaaccagaaatcgaggaggaagcgaaggacgacaactacgatgttgaagcgaacacaccagaagaaccgaaagcaagactgggagacatctacatgctcggggaacacaggctgatatgcggagacagcacgaaggacaagtacgtcgaagccgtgatgtgtggcgaaatggcagaccttctgcttacagatccaccgtacaacgtgaactatgaaggaggaacagggctgaaaatccagaacgacaacatggaggactccgtattcttgaatttcctccacgatgcattccagaccgccaacaggaacatgagagaaggggcagccttctacatctggcacgcagacagcgaaggttacaactttagaacagcgtccagactggtgggctggaaggtgcgccaatgcctcatatggaacaagaacgccctcgtgctgggcagacaggactaccagtggaaacacgaaccgtgcctgtacggatggaaggaaggagcagcgcactatttcgtagacaagcgcaaccttaccacggtcatcgagcagcagctgaagaagctggaggacatgacaaaggacgaaatgaaggaactgctcaagcagatccagaacgaaatgcctgtgtcggtaattgactgcgacaagccgtccaagaacgaagaccacccaaccatgaagccagtaccgctcataggacagcagatgctgaactccaccagaagaggagatatcgtcctcgaccttttcgggggtagcggaacaacgctcatcgcagcagaacagctcggtcgaaagtgccgaatggtggaatacgaccccaagtatgtggatgttatcatcaagcgatgggagaaaatgactggagacaaagcagaattactaacaaacatcgatgatggaacagcagacaatgaagaaaagaatgacggaagcacagctcaataacatcaaagggcacgaattcaagaagggacaaagcggtaaccccaaagggagaccgaagaaccgaataaacaagctgctggcagaaatgctccccagaagccgaatgaagacgctcaaacaggagctgacacacgaggaaatcaacaccatcgagaagcaggtgctacagctcgagctgtcggacttgcagcttatcgccaaagcagaccagacaccagcgtacctcaaaacgctggctatggcgataatcatcgacatgaagaacggaaagaccacgaccgtggacaagctgcgagacaggcagtacggatctgttaagcagaacctcgaggtgcagggagaattgagcttcagccagctcctaatggaaacaggaatgatagacgagaatggagaattgacagactatgatgaaggcgcacaggaatagcccgtgtttttcgatgtgtgcgcttttttcgtccgagaagagtaaacgtacaccagaacaaaaaaacagcgagaaatcgaaaaaacggataaaataactcaatatgcgaaactacgaaaaggaacaactggcaatgaagcgactgatgcagctctggagacaggactggaacagattcgttcgggatgcgctcggggtcaagctggacagcgaacagcaggaaatcctgcactccgttcaattcaatccaagaacgagtgtagccagcggaacagccagaggaaaagacttcgtggcagcgtgtgctgcgatgtccttcctgtaccttacgccccgatggaacagcagaggggaaatggtcgcaaacacaaaggtcgcattgacagcaccaacggacaggcaggtaaagaacatcatgatgcccgaaatatcacgcctgtggaacagggcaaaagccagaggactccagcttacagggaaactgaactcatacgacatcagaacggaaaacgacgaatggttcttgacaggattcaaggcagacgagcacaaccatgaagcgtggtctggattccatgcagtgaacacgatgtttgttgtgaccgaagcgtctggtatcagcgatgacacgttcgcagcgattgaaggaaaccttcaaggaaactcccgtattctcatcgttttcaacccgaacacgaccgtaggatacgcagcaaagagccagaagggggaacgatggaacaaattcagactgaacagccttacagcaccgaacgtggtgcagcggaaacaggtcatatcgggacaggtggactacgaatgggtgcaggacaagctcgagaactggtgcatgaggatatcggaagacgaagcaagcgaagagaacgacgacttctgctttgaaggacaatggtacagaccagaagacctgttcagaatcaaggtgctgggaaaattcccgaaggtttcggaggacgtgctgataccacagcagtggatggaaatggcaatggaacgatggaaacaggcgaatatgaccgagaacgactacaggataaagaaagaaatagacattctcggtgtcgatatcgcaggtatgggacgagacagctcgtgcttcgtccgaagacgtggattctatgtgcagaaaataatctccagaaacagcggaggacaggctgaccacatgagggacgcaggcgatatcatggcgttacgcaggcagaaccccgaaatgtacgtaagcatagacaccatcggagaaggtgcagccgtattctccagatgcgtcgagcaggaagacaacccttcatacattatcagctgcaaatattccgaaggagcgaaaaactcgagcagggaactgaccgacataacggggcagtacaggttcacgaatatgagagcgtacctgttctggtgcgtccgagattggctcaacccgaaaaacggattcaacgccatgctaccaccagacgagggactcctgcaggaagcgaccgaaatacgctggcttttcagatccgacgggaaaatcatcatagagccaaaggacgacatcaagaaaagactgggacgttctcccgataaattcgattcactggcgaacaccttctatcctatcgaaaagcagaagaacaagatagacctcggaaggattgccaaagcaataagacgataacctcaaaaaacaacgattatgacaattgaagaaatcctaaacagcacagaactcagcatcgagcagaaaatagccctgctgaaagagaaaacgattacaatcccaacgtggggaggtgttcgaggtcttgaatcccagtacaaccccaaaaaacacccagtgatgaacaaggcgaaatacccagacatcatcacggatgaaggcgtgcagccagtaaccagaataaccgtagacctgcagagactggcagtaaagcgaatgacggaactggtggcaggaatcccgttcaagcgagtgtacagcccagaaaacgaacagcagaaggaaatcgccacattcatggagcagatattccagaaaaaccgcatcgattcattcaatatcgagcgattgaacatgctgtatgcagggtgcgaggtcatgaccctttggtatgccgtggaacaggacaacgaaatgtacggattcaagagcaagctcaagttcagatgcaggaacttctcccctatgctcggagacgacctgtatccgctcttcgatgaatacggggacatgaccgcaatgtccatcggataccagaggaaggtcggaaagaagacaatccagttcttcgatgcctacacagccacgagacacatcaagtacagcaaccagacaggcagctggcaggagattgaaaacgacgacatcagcaaaatcggcaaaattccatgcatatacgtgtaccgtccgacaccgatatgggaggattcatcacggatcgtggaggaaatcgagtggtcgttgagccgaaacgggaactatctgcgtgagaattcgaagccattgtttgccctttttgcagatgagattgtggactacggaaacgagaaatcgccaaataaggaattcaagagcatcctccagttcccgaaaggaagcaacgcaggatacatcacgtgggaacatgctacagatgcgctaaaattccacgtggacacattgaggagcttgttctttacccagctccagctgccagactggaactacgagaagatgagccaacaggcgatgtctggagagagcaggaagcagatgttcatcgatgcgcagctaaaggtcaaggacgagagcggacgcctgcttgaagggctggacagggaagtgaacgttatccgagagttcctcaagctggcactcccagaaaaatactgggtagacatcgagcgactcaaggtcaagaacgaaataaccccgttccagattggagacgacaaggaaaccatcgagaacctgctgctggctaatggcaacaaaccgctgatgagccagagggacagcatcgaagcctacggaaagagcgatgacgtggagaagaccatgctcgagatagcggatgagaacaaagccgacctgttcgaaccaacggtatagaccgccagacgcacagaaacggctcaaatttgaactttaacacagaagacggaggatttatatggcagcacgaagaaatgcgcccagagcgaacaaaaaagggcaaaacgaatggaacgggaaacattgcagagattgtgccttatcatacgactggcatgataaagcgcacgatggaagtttaatcctttgcaggtgtccacacaaacagcagggaggaaagttctgtatcttcctttcagaccgtgcatgtgaaaaattcgttcaaagaacagaaggaggaacagatggcggacaagtacaatgacaagacaaagaagtacgacgagctacactccaagagactcgccagcattgaacgcaaaatcaaggcagcatacaaaaaggctgcggaggatgcgtcgaagctggcgacagctcctcatttaagctcgaagaagacgtacaagctcgatgattacccacaggcaaagaagcaagcggacaagatcctcgaggagctgcagcagagcgtggagacaatcatcgtcaacggcatagaatcggaatggacgctcgccaacaacaagaataacgagctgtcccagattgtattcggggacaacgtgggaagcctttcagacgagatgtaccagcggtacttcagcaacaaccatgaagcattacaggcgttcattgcgagaaaacaagcaggactgaacctgtcagacagggtatggaaatacactggagcattcaaggacgagatagagaccgcaatagacctcggcattcgttctgggaaatccgctgccgaaatttcaagagatgtgcgttcataccttcagaacccagacaagctattcagaaaagtcaaggacgaatacggtaaactccatctttcaaaggctgccaaagcgtaccaccctggggctggcgtgtacaggagcagctacatgaacgccagacgactggcagtgaccgaaacgaacattgcatacaggacatctgactacatgcgccagcagcagctggacttcatcgtcggaattcgcatcgtattgagcaacaaccacaactgcaaaggagttcctgcagggatgttcttcgatatctgcgacagcctacagggaaactaccccaaggacttcaagttcacgggatggcatccacattgcagatgccacgtagaaaccattctgaaaacgccagaagagctggagatggacacagagaggattctggcaggaaggcagaccacgaacacctcgaagaacaaaatcaaggacgtaccgaaagcattcaaggaatgggtaaaggacaatgaggacaggattctggcagctggggacaaactcccgtatttcctgcgtgataaccagcaaacgtaccagaggattctcggaatccagccagagactccgattgcgcctacagcaacggcactggagaaagcagccatcagacatgcagccagaaccccagaacagcagaaggctatcatagacgcatggaacaaacgtaaggagcagtacgcagtcatcgagaaggaaggaaagcaaatggacgcattgttcaaggacatcagcgatgtggacacaaaagccctcgagaaggctctgaagaagtacgacctaaagaccgtcaagacggaagctgcaaagctgaagaagataaaggacgagctcgagtcctgcgaatggatagagaacccgatggagatggcgaaatcgttctcggcaaaggcagtacgggaaaccgaaaaggacttcgtgttcagaatggatctgtggcagaagaagtacaagtacggaaagttcacggatgcaccgctggaacatcagaaggcaaaactgcaatgggagcttacagacgagatagcagcaggaaaatacaagcatccagatttagcaatgaaggcattgcagaagaagctggacgacgtacaagacaagctggaattcgaggaattcgctgccgtacaggaggaattcaaacaattccagaagctgcataaatcctccgttcttgacaagcaaatcaaggaactggacaacgcaatcaaggctcacgacaagaactccgtaaagaaggcgatatcagaactcgaggagacccagaagaagctggaagcaacagtcaagaaagcgaaaccagcaccgaaggtaaacctcaaatcgccaaacaagaacgtaagcatccagagcaacgagaacacagtcaataactttattgctggaggaaacaaaccatactcaagatacagcaaggaagcaacagactacgtcatcgcaaacagcaatgttgtaagaaacacattcatggaatttgccaagacgaaggaaggtctcgtcttcgaaaaagcagagattgaagcactggcaaaagcaaccagcaaggaaatgctggacgcagaggttcgtaaattgagaaacaaatactggagaaataccagcgaagtaaggaaggtttcagaacttgttgatgaggtttacaaagaatgcgaaatgcaggcacgttccgtgaacaactttacataccaatgggattatgaaatccgccagttccagagaggaaaggctgtaaagtcttatcacggacacacgaaagccgaaatcaaggaaagagcggaatccgtagaaagatttattgcatgtgcaccgaaatggaagggaggagatacattcagaggaatgagcctgtcgaacgaagaactggaagcgttgataaaggacatgaaggatggacagggagacatgctcggaacagcttcatggagttcactccagaaggtatcgcaaggattcgcatccagacacctcggagaatttgatgtaaacggaaacgagaaaaccgtccgagtactgctaaaggcaaagagccacaaacgagcaacgcccataatgcacctgtcggaattctcgtacgaagcggaaatcctgtcgtcgcaatatgagcgatggaagttcgtcaagatgacgaaaaaaatcatcaatggcgatgaattcacgattatcgaggtcgaaccagtttaagccagatattctggaaggacagcatccaaaaagaacgacgcctcgtcctttggagcgacatcggaataatggcaaagaagctcgaacattatggcacggaggtcaagcggaatatccaagaaatccgcaggctttcgtgccaattgcatatgctcgtcagaaagcccagacttaacaagcaagagaatggaggactgctgggcatccccaccattatcgacccacaacttctcagactcccagaagagagaagcacgactattcaagaactgggaaggacactcggtctcacctttgtaaaaacggcattttgccaaaagatcctttttcatacgatacgtattttgagttaataaatcaagttttgccacgtgttcgattttccaaacgaagtgaagcaatcatgcctactcgggagagttaagacgtagggcatttgtggagcttttcggttttcggattagctcctcacgtgtaataacgcacttttccccgaaatagggattgccgtccgctgttttcttgttccagagcgtgcgaagggcaacaccaagctgctgcggagagaacagctcgtagattgcagccagagaaccgaagtagaacgtcatgcgtgggtcgccatcaataggcggtgtcgggaaagcaacccgatagatgtattcctgtttttccatttttcatttttttttgataccgccaccacccgagggacaggcgacgagtatacgtaagtatacgatattcttttctttactctcctatactttgcggttttttgtttacggaaaacccgttcagctggagtttccgcaacggaaaacccgttcagctggagtttcagaccatgaaaacaaaagaacaacaaagaaaccataaaagccagtttttgcaaagttacgagaaaaagccgaaaccgaagaaaataacaaaaggtattttattgaataaaatcccctgcccaacgtcagaaggataagttatggctttttaccatgcaataaatggagtttccgtcgcagaaatccagctcaacgggatttttgtcaacagaaaccccactgaacgggaacactgcaaaacaatcaaatgaatttttccacattggggaagtttttcagaacctttgccctcaaaagagcctcctgcttctccccgtcgcaaacacgaccgtcggaaggattctggaagcgatacgtcgtgtagcgagctacaggcggaagaccctgtctccagtcttcaacagatgcgaacacagagaccgaagtcccatatttcccgtgatgccttgggatgttgtagtgaaattttgcaatcatattttttttatttagcgtaaaacgaaattttaagaccacgacggagcttgcaaacgcaaacgtcctccatgctactgaaggcacggtcaaggaacttgttcagcagatccacgccaatcaaagcgaccagaccagcaacaccgaccagcttgttaatgcgatgaccagcagcatcgatgccgtacactttcaaacggaaattacgattgataaccgaagttgagtaattgaggattgaacactttttcataaggcacaggatttaaaatttgattgaaacgaaatcgaagcgaatgatggcagaaaccaaatcttccaaacagcggaaatcacgtttaatacgaccgaactgataagaataaacttcgtcgccattagtgcgagccatagaaatcacgtaagtaaaaccatcaacacgagtaacggttacaggataaccttcagttacattgtccaagattgctgcgaaatttgaaatcaaactaaccatatttaaaatttttagaattcaacattagcgttttaaccacaatgcaaagttagggaaatatatcgaatatacttactttatcttgctaaagattgctaactttcaacggattctgcaatatttctgccagatagccccaaaacccacttgtacaggcaataaaaacatttatcgtgcgtgaataaataaaaaaagtgattgccaaacaaccattttaagaaaaatcccatatctttgcatatcaactttttagtttaatcaaatttcatcgagatgagacagcaaatattagacgcactgaaagccaaattcacgggggtcagcgacgcaattctcggtaggattgccgacaaattgagcaagactatcaccaacgctgaacagattgcaaccgcagtagagggggtaaccttccagcaagttcttgaatcgtacggagacagccgagcaaccgaagcccagcagacagcagtccgtaactacgaaacaaagcacggattgaaggacggggtcaagattgaccagcagccaccgaaggaggacaaacacgaagacgttccgtcttgggcgcagagcatactggatgcgaacaagaaattgaacgaacgtctggacaagatggactcggaaagaacgacaacatcaagaaaacagcagctggacgcaatcatcgacaagctgccagattcctacaagaacgcatacaagcgcatcagcgtggaaagcatgacagaggaagaattcaattcgcttgtgggagaaatcaacacagaagttgaaggcatcatggcagacgtcaatgccaaaggcgcagttttcggaagaccagccagaacaactggcggaggaagtaacgacggcaaactcacagaagagcagttaaatgccatttcgacaagaacaggctcaacaaaagaaggacagccgttttaagtttaacaattaaaaccaaagcaacatgggaatgaccgtaagaagagtgaaggacaccagaaccaagaaggtgttcatgcacaagattgctgacatccgtggcggtgttgcagtgaagacttccgagcttggtggagactacatcccagaaggagcggttctcagccagccagacaacggaatctgccacgtcgtaaaaatcgcacaggtaatagcggaagtgacagcatctggaacagaaatcaagattgcgaagaattcgtgcttcaaggtcggagacttcgtgatggcagaggtgggcgcaaaagcctacgcaatcactgcaatcgactacagcaacagcgagtacgacaccgtaacaatcggaacaaccctcggcaagaaaatcgagaagggagcgttcatcgcagaagcagcagctcaatcagcagacacgacttcagcattgaagtaccagccattgtcgatggtcggcacaggaaagcctttcaaagcaggcgacaacgtggacacagacgcatggatcatcggagttacaacaggcaacccactgcctgcattcatcgagctgaagggaattattaactattaacaaaaggagaatttatgccaacaattacaggaacactcatacagggcttgacccagcagatggtacaagcccgtctgaacacagcagacgcaacaccgttcttgtttggtacgcacttcccagtgaagaaggtaaacggattcatctggagaaccctgcagaaccaaatcgagaaaaagaacgtggcagcagacctgcattcagacaactcgtcaatccagagaaagagacgtccaatcttcgaaagcgcaagaggagacatcccgttcatcagcatttcacgagaaatgacccgtagcgaaatcaaggactaccagacagcccttgcattcgcaccagacgcagacgcaacagccctcgtggagtactggggtaacgacgttgacttctgcttcaacggtttgcagagcgagctggaattcatcgcatggaaactggcttcaaacgctggtaaactggcgtttacaaccacaacaaacgcaacctacgcaaatgaattcgacctcgactacgacgtagacgcagagaagaaggtaaaaacaaccacagactggtctaacaaatcaagtgccgacattatcggagacttggcgaaaatcatcaaggaagccaaggctatgaatctcaacccgaaatttgcgtttatcaacctcgacgagctgtacaagatttgttcagcagaacagatcatcaaggcttgttcaagctacatcgcaaatgcggtaggttcagcccagacaccagacctcgctgcagtcaacacaatgctggcaaaacaggcatggctcaacggcatacagctccgagttatcgaccagaccatcacccgagagttcgcagacggaacaacaacatctgcaaacccattcgagaacgcacgccttgtcctttcagagaccgaaattctgggctcaacccagtacgacatcctgcaggagaacaacgaatcaatcattcgtgcggaacgttcgcataccgtcatcaagaagtacggaacagcagaaccgcagtcagaggttacaatcggacaggcagacgcagtcccagtatttgataccgcataccgcaacgtgtacgtccgtaccgatgcacaggagtgggaataaacgcatgagtgatggcaaagattatcgaacatctgaaaagctccaacgcctacccagtgccgtctccagtattttctggagcagcactacgatgggatgttgaccttcaagcggaaatgacaaaggacacgctcaaaagcaagggatacaacctgtgccgagccgaggttctggaatggctggcaaaagccccgaacatttcgcagggaggacagaactacagcttcagtgaagaagaacgtaagcagttcagaaacgaagcgcaatccatacgaatagaattcggggagaacgaaggagcaaagaagacattatacggatacaaaggctcaagattatgataataccaaacggaacgctggaattcaagacgaaacaggttcgaggtgcagacccgaacacaggctaccctctcccaccagaggagacatggggagagcctgtaccgtgccaatactaccagaacagcaggaacatgctggcaatggtgggcaaggaaaccagagatttagccagctataccatcttgattgaaggaaaggcacaaggcgaatcaatgagactgacaagcgacgacggcacgatcgtcggagaattctcggctgtttcgattgaggagttgagagctgtaggacaaacgaaaatcgtgatttgacatggctattaaacaaacgacaccacagaacatcgtgaatgcatacctcgaccaagagatacagcgaagagaacaggctttgctgtacaatctcgcatacgtcggggaaatgtgtatcaacgaagccagaagcacgacgaaggcagcaaacaactacaaagaccagacaggaaacctccgaagctcggtcggatacgttctggttcataacggcaggatagtccagtcctccagcttcaagagcgtcctaaacggacagcagggagcaacagagggaagcggatatgcaaagcaactcgccaagaaatacagacaagggattgtgctgattctggtcgcaggaatgaactatgccgtacacgtccagaacaaaggatacgacgttctgacgagcgcagaactgatggcagagagacttgtaccgaggataatgaaacagcttggaattacaaaatgacaaagacaggaaaacagatagaacaggatttgtggatgatgctcagcgacagcatcctcggactttccattacaggaaaggtataccgaaaagggcagagaccacgagactcgaagctggaagacgctgtcgtgattttcacttctggtagcacatcccagattcagaacggggtcgttacaataaacatatacgtcccagacaaggacttctatgggaacggacaacttctggaggacgggaacaggacatcagagctggaggagagagcgcagcgatgggtcgacggattgacctgcgacctgtcgaactacaagttcaagctgcgacagaccatcacgacagaccacgaaccagagattcatcaacattttgtggtggtgattctcgaatacgattactacgcagacgacactgatgaaaacccgattatctgctcggaggacggagacgaaataaacatattcccgatgcagctgaagacagaacaaccgcacgcagtggaagtccgcacaacaaaagtttaaccattaaacatcaacgaatatggcagtattatcatggggtaaatgtttgctcgagcacacgccatccgtagacggagcaccagcaccagaaggtccgtggacggcactcgacacaccgaaggaagactccaccgtgctgaccccaacagcaggaacggagacagtagcaaccgaagaaggtggagacgtcgtggacgttatgtacggaaagaatacatacgagttcgcattcgacatcttcgtgaagaaaggaaagacccgtccgtttgaggacaacgatggtatcgttgagggagaacacgcaatccgtctgaccccagaagacgaagaatgcgaaggaatccagattgacagatgcaagatccgtgttgaagagagctacaataccaaggacggtattctcctgcatcacgtttgcaaatgcctcaagccgaagacaggcaacaccatcaagccgtacaccaaggaagcctaacagcttacttttccatttctgacccgaaggggtggcgtaacaaaccaccccgatacagcgaggtggagcagcggaagctcgtcggcttcatgagccgaaggtcgcaggttcgagtcctgccctcgcaacaacgaaaaaacgcctgtgtgcgcctgttttttccgagtaagggaaacggacgctggaaaggagaaaagccagcacaggcgaaatatgctataaataacaacgattatgaacaaaacgatagaacaacaggtctccgataccatccttcagcagccgaccgagatacaggtcggtgagaagaaatacagcgtagctccaccatcgatagctacgctgattcttgtttcaaaggaaatcagcaagctcccgaagatacaggtcgataaggacgaggacgttctggcaaccagcctgtcaatggcaaaggactgcggtatcatcggacgaatcgcagcgacactgatcctcggagcaaagaactgcaaggacaagaccatccatgtccagacaaagaagaccagacgaatcctgtggggactgatacctgtaacatgggattcatacgaggaacagacccagaacacggtggacgagctggcaaaggaactcctcgaacagatgacaccgagggagataaacaacaccatcgcacgaatcctacagggcatgcagataggtgattttttcggagttaccactttccttctcgaggtaaatctgaccaagaggacgaaagtggaatgaccgacagcatctgggcagtcgtggcagggacagcaaagacattcgggcttacattcgattacgtactgcacgagattagctacacaaactgcatcctttacggggcatccctcccgacctacgaaagcaagaagaaggacgagaagaaaaaggatgaggaggtcatcaaggcagacgaccccagcaacaaagaacgagtatccaaactaatagcatcattcaaataatggcagacggaagaatttcatatagcgtagggctggacaataccaagctgaggacggatgcagcggaaacacgcaacatccttcaaggcatcagctcgtccgcaattcaagagggacagcgcatggaggaatcattcagcaatatcgggaaaaccattgctggagcattatccgcagcagcagccatgtccttcttgaaccagataaagaacgtgagagcggaaatccagtctctggaaatttcgttcacgacactgcttggttcgcaggcaaaagcccagtccctgttcggggaaatccgaaaatttgccgtggaaaccccgatgatgctgaaagaccttgcaagcggagcacagaccatgctcggattcggaatcgcagcagaagagataatgccgattttgaaggcaatcggagacgtgagcatgggagattctcagagattccagagcttaacactttcgttctcccaagcaaccgcagcaggaaagctgatgggaggagacctgctccagatgattaatgcaggattcaacccactcgcacagatagcggaaagaacaggcaaaagcattgcaaccctaaaggacgaaatgagcgaaggcaagatatcagccgacatgctaaagcaagcgttcattgatgcaacgtccgagggaggtaaattcaacgggatgctcgagcagcagagcaaaggtataaacggggcaatctcaaacctgttcggagcaatcgacgacatgtacaacgacatcggagaaaagctcgagaaaccgttcgtggacatgaccctgctggcaactgaactcgtgaagcattacgaggaaatagccaaggttctggctgttgtcgtggctgcatacggaacatacaaggcagcacttatcgcagtggtagcctaccaaaaaggacttgcaatatggggacaggtgcaggctttcctttcactcacgaagagcataaagagcgcaaaggacgcaatgctcctgctgaacatggtaaccaaagcgaacccaatcggactccttctgtcagccgtggcagcagcagctacagcattcgcattattctccgattcggcagacgaagcagcagaatcgctaaacaaggaagccgaagaagcagaggagttcaacaggcgtgtatcagaaagtgcaggtaaagcccaatccgaatacgcaaagctgcagaaggaatacaaagcctgcaagacggaacaccagaagaccgaatggataaggaacagccagtccaagtttaaggaactggggatatcggtaaattcagtcaacactgcggaaaacgtattcatcaagaacaccaaactcatgctggaagcattcaagaaaagagccgaagctgcagcatggcagtccaaagttgaagatgaatacgcaaagagagtggaacgccagctccagctggaacagcagaaagacaaaattcaagctggaagcaaggtgtacggttcatcccatacaaccgaaggaggaaacgaatacgtcaataaccaaggcgaatgggtgtacacggaacagggagcagccagagctagggcagccatagatcagagcataaagaacgacccagtaatcgcagccatagatgccaagatagaccaatacagcaagaaggtagccaccctatcaaccgaaatggagagcctgtatgaaaaagcaggaaacgacccagaactgacggacgaacagaaaaaggctgcccaaaaagctgccgaggaacaacagaaactggcagatgcccacgcaaaaagagaggagcagatacgagccaatatcgagagcgagaaggagctgataaggaaaggcgaactggacatccagcaggcaaagataaacgctatggaggaaggcgtggataaagaactggcacagaacaagctcaactacgaccgcctcatggcagagaacgaaaagcgcaggaacgagatgctcaagacactcgaggacaccaaggttctggaatggaagcagaagaaccctaaagcgaccgacgaacaggaaatcaagtacagagcgtctttgaacctcactgcagccgacctgtcctcctcccagagagcgcagctcgacgagttcgcacgcattgcagccgaagccttcgaacaggcaaaccagaaatcgctggacaagatgctgcaggacgtgatgacatacgagcagaagcgagcgcaggttacagagcagtacgccaagatgagggagaacctcgaatactcccatgacgagactggagcgagaacaggaaaaagagaaggagtcagccaaggaaacctcgatgaactcgacagacagagggacgaagcccttcttgccatcgacgaggagttcgcaagcagacaggaatcctaccaagcatggatggacagcatcgcaaacatgacactcgagcagctgaaccaagttctcgaacaggcaaaacaggaactggactcaatgaagaaggacggtactggaggtacagcccttgcacaggcaagagcaaaggtagccaacacacagaaggcaatctcaaaggcttctgcaaagaaggatttatcgccagacaaacgcacgctgaaagactggaaagaactttatgacgtcctgcaggaaggcgtgaagggattcgaggaaatcggagacgctgtaggaggaacagctggagaaatgatgaaggcagctggacagattgcaacaggtgcactttccatgataaacggaatcatgacactggttcagagttcaacagcaggaatgcaggcaacagcaacagcaggagcagcagccatgagtaccgtggagaaggcatcggttattctggcggtaatttccgcagcactccagatagccaccgcaatcgcagggatgttcaaccaagacgaccagaaacaggaggaaatcgaagccctgcagggaagaatagaccagctgcaatgggagcttgataacgcagatgttgtgcgtttacgggaaaatgcattcagcgcaatcgacaaggtaagggaatcactcgcagccacaagagcggagctgttgaagacgaacattgcgacgaagaactggcaaggaatcatcggagcgatatacggaacggtacgcacaaacaatgagcttctaacagaatctgcgaagaaggtagccgacgcatacgcagacatagcatactcggcaaacaaggcactcggacaggaaagatacgacaatgcccgtgaggatctggagaacatcgccaagcagcagctgctgatgcaggagcaaatcagacaggaacaggacaagaaagactccgaccaaggagcaatacaggactaccagaacaaaatcgaggaactcggaaaccaagccgtggaaatcataaacacgatggtcgaggacatcatcggaggttcggcagccgacatagcgcaacagctcggagacgcattcttcgaagcgttccagaacggagaggatgcagccaaagcatggggagacaccgtgaacgatatagtggcagacatcatgaagcggatgcttatacagaaatttctcgaagagccactcggtgagattttcgacaagtacaaacagaaatggtttccaaacggtatcggagcaaacgccatagacagcgtcctcagttcactgggagacttccagaacgacctccagaacgtaggcgacacattcatggacatgtgggagcaaatgccagaggatttcaagaacctgctcgcccctgttgaggacgcagcaagggaagcatctgagaaaggcatagcgactgcatcgcaggaaagcgtggatgagctcaacggacgagcaacagcgatacagggacacacctactccatcatggagaacaccaaacttctggtagccaacaccaatgcgattctggaaagcgtgatgaacatcgacaggaacacggactccatgaacgaaagaatccagagcatggagggaaacgtgcaggagttgaaggatacagtaaacgacatcgccctaaaaggcataaaaatgaaatgatatggaacagaacgaattcatacagaacatacggaagcaatggctggcagtcaaggctggagcagcgatggactgcgaagccaagaacctcccgaatctggcgaaggcatacagggagtgcgcaatgttcagaggagatgaaaccgtacagcagctggcagagctcatgaaatcagcgaaaggttcagagttctgcttgaagtacaacttcccgaacattgcctccttgcgttttttcaaaccgcagaacccagcaaggtacggggtgtacatcgacggtggatcggtcaagatgaagaacccagaacaaggaacaatcattctggcaggaagaatcgcagccaccatagacatcgatgacaacagcaagagatacgaaatcattctgatgcacggggcaaaggctgtcatcaacgccagatactggtcggtcgtttcagtaaagacaggacagggatgcattgccgtacgcaacgcaactgaaaacgcaatcatattatgagaacaggaacgctgtacatagacgggaacgacgcataccgccagttcggggtgtatgtggtggacggaggatatgatgatatcgtagcgatgccacctatcaagcaaccgcagacgaacgactggcaagaagaggacggaatagaagccgacctcacagaaccagtcctcgacgcaagggagatatcggtcaagttcgcaattgcaggcatgttcaacaggtacgaggaattcgtggctttactggcagacggagcataccatatcttcaattttgccgagatacagaggacatacaagctgagacttgtcagctgtccaacgaaggacgacgtcagaaggctcggagtgattacactcaagctcgctgacgacttcccgatgtttgagtaccagtacagcgaaccagaaacgaacatacgcccaaaagacgactactacatcgacaacgtggatgtggcggagtacggggtgaggattctggaaggaacgaggaaggaaattactgcaatcccagaagtgaagaagaacctcgagatagaatcggactacacagcagggaagacatacgaccctaacatcgtgactttcaaaagcatggacgcaaagataaactgccttattcacgcagagaatctggaacagctatggaggaattacgacgcactgctttataatttgattcaaccagaagaaagggagctgtattcaaaggagctggagcacacgttcttcttttactacaagtcctgcaaggttacctcattcagcccgaaggacagctggctccagttcacgctaacgctaacgctgacaggaaacatcagactatctgcagacggagattttgttctggcagcagagaacggagacatcatcattacagaggacggagtatacgcaatagacatgacaccagacagattcagctacccgagcgtcagactcatcaacgatagaaaaacgcttcggttcactggttcgggaggtttcagatttaacaattaaaacaaaagctcatgaagaaagtaaaagtatcagaattacagctgtacgagagcttgaaagggctctacacgcttggagtgacaaaagaaaacaggagcgtcaaggtttccctcgaattcatagagacgaagaccaccgaagccgttctcaatgcagaaaaagccacagaggaagcgtacaaatccatttctgctgcaacacaggcgaccaacaccgcaaacaacgctgcgcaaacagccatcgaatcaaccaagaactgcgagaaggcaaccgctgaatccatcaaggttacagaagagacacaggtggctaaacaggcaacagtagaagctacacaggctgccaacacagcgacgcagaatgcacaggctgccacgaagcaggctacacaggctgccacaaatgcaaacaacgcagcaacacaggcacagaccagtacgcagcaggcaatccaatcgatgcagcagcagacgaacgaaacgctcgaacaggcagagcaggacatccagcagaacatcgacaagaacaaccaagcaacagaagaagcggtggaagcagcaaacgcagccacggaagcagcacagaacgcaacggttcagattacggaagcattcacgaacctcatacccacagggctggcagttcaagctccaacattcctaacgataggaaacaaagaaccgaactacatcaaggctacgctcgccccagagaacacgatggagaacatcatcttcatgtcagacaaccgagccgtagacgttgacttagacggaaagctgacgattgtggcaaaaggggtcagcaggattcatgtaatcccgacgatgaacaccaaactggcgaagacaatccttgtacaggtgggagatccgacaatgagactcggggacaccagagcacaaatgaggttcacttcaacaggagcaataagattcaattaaagtttaacattaaaacagaagaaaaatggcactatcagaagcacaggaacaaatcctgcaggaaattatcgaagcattccagaacggaaagcgattgagcgaactaccagaggtcggagacacaaacccgtataacttgatggtggaagttctcgaaaaaggagagagcaaacgagcaaccctcgcatcgctcctgccatacatggaggacgaatgcagctacggtgtggaatttgacacgacggtaagcacgccaacatgtacacgaatcggaaacatgaacctccacaagacactgccagtacaaagcctcatgaagggatgcacgctgggagacgacggacaggtggtggactacctgccagtaaaagactgggcaggagcagtcagagacggaagccgaggacaggtaatggttgaacttccgctttactacagaaaattcgaaaccgaaggaacaaaacgcagggtgcgcatttcccttctcccactccctggctaccaccaagtaccacgcaaatacgtgagtgcatacgaagctacactggatagaacaggcatgaaactggcatccgtcgtgaacatggcagcccagtaccgaggaggaaacaacaacgaagcgtacgacggaacatgccgaacattcctcggacgaccagtaacacaaacaagcagaaccaacttccgaaagtacgccagagcgagaggtgctgtaggaaagaacggatgcggatggaactgcatgacctacgacatccagaaggacatctactggctgtttgttgtggaatttgcaacattgaacacacaggctggatacaacgcacagcttacagcagaaggatacagacaaggcggtctgggagaaggagtaacctccgtaggttttgccatcggttcagacaaagagcatcacggagaaacaacagaatcatgggcggtgttcaacggaaactacccgtgggtgccttgcggaacaaccgacgcactgggcaacggaacaggacaggtggaatacagccagcaagacaccgacacaggcgcatggctcgaccaattcgtgccgagatatcgaggtattgaaaacccgttcggacacatctggcaatggacagacggaatcaacgttcgcatcaaccctgcagcaaccagcggaggaaacgacaagagcgaagttttcgtttgcgaagacccagcacaatttactgattctggctacgacggatacagcctcgtgggactggaagcacgaaacgaaagctacgtgaaggaggttatcttcggagaaggtggcgaaatcatgccttcagtatgcagcggagcaggctcaaccacataccactgcgactaccactacaccaacataccgacgaccaccaccctgcgtggtgtccagttcgatggttcttcgtttagcggttcgtatgcgggtctcgtgtatgcgacttcgattaacgccccctcggctacgattacgaacgtcggctctcggctttgctttttaccgtaaagcgagcgcacgaccctaaacgggtgcgagagaccccttgtgggtctccacccctatagcagaaggaaggaacaacaataacgaataaaaggctggtcgtttcaagcgtggtgtcctgttcggtggtaattcgaataacggtacgaatgcaggtctcgtgtatgcgaattcgaataacaccccctcgaatacgaatacgaacatcggctctcagctatactttcagaaggggaaacccttcaacaacaagaaggaacgacaaccctgccccttggcaaaaaacataaaactcaagaacggagtcggtaggagaaatccgaagaccccaattaatgaaagcaaacgatgaaaagaataggcaaccttacgaaaaaataatcagcatcgagaacttgaatctggctgacgaaaaagcccgaaaggggaagacgcattcatacggagtgcaacttcacgacaaaaacagggaagccaacattgctgcattacacgaggttctcaagagaagagagtacaagacatccgagtactgcatcttcacgatccaagaaccgaaagagagacttatttacagacttccatatttcccagacagaatagtccaccacgcagtgatgaacatcctcgagggcatctgggtgtcgatattcacgcaggacacattcagctgcatcaaggaacgaggaatcaacaggtgcatggaacgggtggatgaagcgttgaaggacaaggaaggaacacgttattgtttaaaactggacattcggaaattttatccaagcatcgaccacgaggtcatgaaaaggataatccgacgaaagataaagtgcaaagataccctcaatcttctggacgagataatagacagcgcagaagggcttccgatagggaactacctatcccagtatctcgccaatctttaccttgcatacttcgaccattgggtcaaggaacagaagagagtgcggtattatttcagatatgccgacgacatggtcatactggctaaaacaaaggacgaactgcacaagctgttcgaggagatacgccagtacatgaaggaagagctcctgctggagataaaagacaactggcaggtattcccgatagcagagaaccgatacgacaagacaggacgaggtcttgattttgtaggattcgttttctaccataggcagaagctgataagaaagagcaccaagaaaaacctatgtaggacagcatccagactggcaaggctcgaccctccactttcaagacatggattcaagatgggcattgcttcatggctcggatggtgcaaatacagcgattcaagaaacctattaaagaaactttttaatttacacgaaaatggcaaattacagcgaaaaaccaaatgcgtttgaaccagtaggaaatggttcattcctttacagattcaacattcaagaagtaacaactgaacagcagacagaggttcagacgttagagggcgagggaacagaagtccaagaaccacgtacatcatggaattgcgacgaagttaccgtttatccaccagtgacagccaacagcatcactgaagccgtgatagcccacaaatgggatgcaagttacgaaaagaagctcatcaatgagtacaatgcagcgaaacttggactgattggaggaagcacgacatcagccgaagccaaggcagtcattgagaaatacaaagcattccttgttgagcgacaggctttaaaggacagcgtggatgcaacctgtttagaacttggaatacactaatggcaaagagattcagcgagcttgggattacccctaccgatgaacgaaaaatattcaactgccagcaggtatccataacggacgtcctcaacagcgagattgaagttatcgactacctccccgacatcaagacaccacacggggagggtcgatacctcgttcatttcagacaggtagacaacggagcagaaggtaaattcttcacgaattcgagctcgataaaaagcgtgctccagcagataagaccagaggatttcccgttcataacgacaataaaagccatgaggtgcggaacgggaaagatgtacaaattcacatgacccgaaataaggcggtttctgccttcgttttgtgccgtttgaacaaatgcacatccagaagacaaaaagggcttacagggaaaatctgatataaataacagcaatatgaagatatataaccagcaaggaagaatcttatacgaagggcaggtcgaggacaacagctatgcttcagacgcaatcatggacgacaatagcctaaccctgtacatcaagacgacagaaccactggagctgccagtcggggcttattgcacgttcgagaaccagaagtacacgctgatgcgaccagagagcttcaagaaaaacaacagcaggaacttctcgtacaccgtgacaatggaaagcgaagctgcgaaggcgaagatctggaaattcagaaatccagtagacggacgtctccagttttcgctgacagcaaaaccaatcgaacacctccagatggtggtggacaacttgaaccgcagggacggaggatggagcgtcggacaatgcatcgacgatgtggagcataccatcacgtatgaccataactacattatcgacgcactggtagcgcaggcaaccgaattcaacacggagtacgagttcaagggaaaggtcgtcaatcttcggaaggtggaatacaacaagaacaaccctctcccattgagctacggacgaggaaacggattcaagactggggtcggtcgttccaaccagaacgaaaacatgcctgttgaaatcctattcgtacaaggcggtacaaagaacatagacccgagccaatacggacataaagagctgctcctgccagaaggaggagagatagcgtacgacggtcagtacttcgaggatgaagaaggattcaacgaaaagaccgcacgccactacatcgtatcagaagaccgcctgtcaatccgaagagacgacggagtgctgagtacgctggcagaagacagtctggactgctcagaggtttacccgaagagagaaggactggtgtccgaggttatcacggtggatgcagagaagaacttctacgatttcacggactcatcgataccatcgacgctgaactttgaagaccacctcatagaaggcgaaaagatgaccgtcatctttcagagcggaatgctggcaggtcgggagttcgaggtcaagtattaccacgacgcacaggacgggaaacttgggcgaagattcgagatagtaccgcaggagattgatggcgagaccatgccaaacgaaacgttcaaaccctcaaaagacgacaagtatgcagtattcaactgcaccctcccagaagagtacataaacgacaaggagcataagcagggagctgaatgggacatgttcagaacagccgtgaaatacaagtacgaaaacgaagaccagaaattcacgttcactggcacactggacgggatatggtcgaagaaggactgggtaaacataggaggaaggattatcctcggagggtacatcagattttcagacaaccagttccagaaggaaggagtgaacgtaaggattacggctgtaaagaagtacatcaacaatccacactccccagaaatcacgctgtccaacagcacggtcacaggctcggttacaggaacgctgaacgagctgcaggcgcaggaggtcgtgatacaggaaacgagaagagaagcaatccagtacacgaagcgaagattcagagacgcacaggaaaccagcgaaatgctccgtgcgttgatagatagctccgtcgattcgctgacacagcagttcacggaaggaataacacctataagcatacagaccatgcagctgctcgtaggagacgagagcctgcagttcagatacgtaaactcggacaagaacccacagcctgtaggagacggcataacctacgacacagaaatgaagcagatccatgcaccagagcgaatcgtccagcacatgacactgggcatatcgacgataagctcaagccacaaggagagcgaatacaagttctggagggtagccgaatacaacagcgcagttcttgaggatgcagacaagaaatactacctgtacataaaagcagcggagaacgggactggctcctacacgctgagcgaaaaggctctggacttcaaggaagggacgacatacaacctgctggtcggagttttgaacagcgaatatgacggagtgcgcagctttgccaccctttacggatttaccgagattctcccatcaaggataaccacggacaaaatagtttctggggacgggacatcctacttcgacatgcagaacaacgcaatgaagctgggagacgctatggacttcaacagcgacgggacaaagagactgaagctgaagggaacgctcgtccagtcagagagcggagactttatcgatatcggaagtttccgtggggagtataactcaaaaaccacatacttcctcggggacaccgtgacatacacgccttctgggaaaaaaacatcgacctacaagagcatatcagagcagccgtttacaggcatagcccctaccaacgaattatactggtctttgacagcagctggaggagaagacggaacaagcatatcaatcaagggaacaaccaatggacactacacgaacaagaacgcattcgtggcagcagggcatacgtctggaactttcctaatcgacatgaaggaggacgaatccccagtatcataccactgggtagcaaagagaagcggaagtacatgggcttactcgcaggcagaactcggagacggatacatggacgcagaaggatacctgtgggtcgcagaggagaacggatggaaaaacgtcggcaagatcaagggagaagacggacatgacggaacagacggaaaggacggggaatacacggagtaccgatttgcaaggaacggaagtacaacaacccctcctaccatcagcaagacatcccctacaccgagcggatggtcgcttactatgccagcaacaggactggggtggtacacttgggcaaccaaggcaagaaaaaccgcagcaggggcactcgtagaaaactggtgtacacctttcagaatcacgccatacgacggacaggacggacatgacggacagcagggcaaaagtccagcagccatctatcgtggaacatacgacgcaagcaaaacctactacggaaacgagttcagactggacgtggtcaaatacggaagcacatactacattgcacagataacagcaggaacattctccaatgtcgtgccgaccaacacaagcaaatggaacgccttcggtgcgagctttgacagcgtggcgacaaacctcctgcttgcagagaacgcaaatgtaggtggatggatattcagaaacggagttctggagagcgaaaacggatcatcatggttgaacggaaaaacagggcaggctcgccttcgaggaacgatgcagctttccacagcttacaaaggagtaaccaccgacgcaaacatattctacatgccagcaataacaagcagtaagtccgtaggactgacagccgaaaaaactgacataggaaaggtttgtagattttacaactcatcagcaaaaggaggaggaacatggactatttacatttacgaagatgttacatgcacacaggacgctgacggaaatacgtacaccacaagatacaaatatacaggatatagggtcgcaccaaaagagtccatagaatttacatgttttgagagacagccaccaaattcatacgaaaaaagctacagcctatcatggcagtgtacaaaccgatttacggtcaatgaatggcaacaggaatcatgcaaaggacgctacccacgaatactggcaatgggaaaaattacaggaacgagcaatacagcatatctttctggagaattccacgacggaagaagcatatcttcagtgttcagtgtttcgaggtcgggaaaaggggaatatacggtttcattcgcaagcggaactttaccgagcggatattttgtattcgtggtcggaagctcccctatttacggaggaagccaaccgaacaaggcgtccatcgactcgaagggaactacctcgtttgtcgtttcaatttccgacgacgattccagaaacgacggtagcgtagactttataatattctcgccaaactggagctattcgacagattgggattaaaaagatttcggaaagtgattgcattacaatcattttccatatctttgtaagcaacgaaacataaaagagcaaaccaatgaacgatattttaattaccgtaggctcactaataggagcacttggaggactggaattcatcaaatacctcctcaacaggaagagcaacgcacgcattgcggaagctaacgcattcgagatacagaggaaggcaatcatcgaggattacaaccgagtacagggagaggtcgaggttttgaagaagaaggtggacgagctttataacaaaatccatgatatggaatgtgagcgactcgaccttatcaaggagaacaacgagctgaagctgaaactgaaggaagcagagaaacacatgtgcattcaaccagatgacaagtgcctccagcgtcttaacccagaagcgaaatgtcgtctggtaaaacttcttcgtggagaatatctcgaagaccacccagacgcaattctgacagaggaagacatgatgaaagaaatagataacgaacaaacaaaagaacaggatcatgattaaaaaaattttagaatacacaggacaggacggactgctgcacatcatttgcagcagccttcttgtcggtcttttgaccctttttacaacactgactgtggctgtcataacaactgcagccgtgggactggcaaaggaattcatatgggacaaacacctcaaaaaggggacattcgagaccaaggatttgatttgtgacttaatcggcatttttataggatgcctttaaaatggaggataaaatatgatagtactacttgacaacggacacggtaaagacaccgcaggcaaacgctctccagacggaagacttctggaatacgcatacgcaagagaaattacaaaacgcatggagcaggcactgaaagcacagggatacgacgtacgtctgattgttccagaagagaatgacatcagcctgcaggaaagatgcaacagagtgaacagaatatgcgaccagtacgggacaaagaacgtcattctcgtttcagttcactgcaatgcagcaggcatgggcacaagctggatgacaggcagaggatgggaagcatggacaagcgtcggacagaccaaggctgacgagctggcgacatgcatctacaaggcagcagagaaagaagggctcaaaataaggaaggacgaaaccgacggagacccagacaaggaaggacacctgtacatcctcaagcacacgaaatgcccatccgttctgacagagaacatgttccaagacaacaaggaagacgtggaattcctgctgaccgaaaacgggaaacaggtcataacccgagtgaatgtaaacggaatcatcgaatacatcaaaacccagaagtcatgaagcagcttatagccttttttgcaatcctcctgcttacaggatgtgcagcaggaagaaaagctggacagcagaccgcatcgaaggacagcacacgggtcgaagtgagaatcgagaagatcatcaaaaccgacaccgtatacatagacatcccgaagatagtcgagaagaacgtgaccaaggaagaccactccttcctcgaaaacgaatacgccaagtcagaagccagcatcgacagcacaggcatgcttcatcattcactggagacaaaagcccagaagaaaccagttcccgtcaagacagagagcgagagacgggacagcatcatctacaagaacagggaagtgaaggtggagaaaccaatctacatagaaaaggagcttacttgggtacagcaggcgcagatctacggattcagagtgatggtcgccatagctgcactttgggcattgataaagtacaggaagaaaataaccacattcgtaagaaaaatcatttaaccataaataattgatagcacgtgcaaggaagcggagtcgttgagaaacgaccccgtttttttgtttttgttgtagatttgttgctcaagaaaaaacacaaaacacaaaaagcctttgtaaatcaatgaataccaacacgttacactactttctgtgtgggaaaatgagtttctgcatcggcaagtaactatctgattatcaatgagttaaattgattataatcgattgatatggcgctctttacggggcgccttttttgttgctctactgtcaatattagtcatttataagctttgcacatcatctttttgtaccgtttttgtaccacgaagcaaaattctggcattttacgctggacagattgtggagtgagtttacgccattttacagaattttacgggattatacagattattgggtgaaataaagcgaaataaaatgaaaagtagaattgaaattaaaagaatttgtgcctggtgcggtaaagaatttattgcctacaaaacgacgacaaattgttgttcccataagtgtggaaacgcattatataagaaacgtaagcgtgatgcagcaataattgccaataataatttaactgaaaaaattgttacagaaaaacctattgagaagattaaagacaaaccttttctgactattacagaaactgcaatttatcttggagtaacaagaccaacaatatatggttaccttaaacgaggcgatctaaaagcaacacgtataggaactaaatttcttttaagcaaagatgacataaacaatatgtttaatcatcctgcagattttaagttgccacctaaggaaaaacaagcaatcacagaattttatactacagctgaaattatagaaaaattcaatgttagcgaatcatggatatttgtgatggctaagaaaaataaaattcccaaaacgttcaatcggggtaagacttactggagtaaaaagcatgttgatgcttatttttcctcgaaggctccagatgcagacattccagaatggtatagtgtgcaagaagtacaggacaaatttcaaatgagtcttaatgctatatactcttttgtttataaaaatgtcattccgaaaaagaaggttggtattactgtatactattcaaaaaagcacttcgatatagcaaagggaatacgtcaggctgaagaacccaaatactatacagttcgagaagctatggaaaaattcaaaataacaagagaccagctataccattataccaagtatcatcaaattcccaagattaaaaagggaaaatatactcttatatccaaacctgagctcgataatttgtttgaagatcctatcattgaataatcccggtataagttatttcccggtgtgagtattcaccaagaaaacaccagtttaatttgtaccgataataataatttatcaaccaaaaacattaatcttatggcacttacatgtactaacgtaacattgagacaaagagttatcagtaacggcagaatttctctctacctggactattatccggctattcgcaatccgtacacaatgaaaatgagccgcagggaatatcttggcatttatatctatgcccgtcctaaaaatgagattgaacgtgatttcaacaacgagatgctgagtaaggctgaagccattcgttgtatcagagtacaggcaatcgttaatgaggagtttggatttcttgacaaacacaaaatgaaagctgacttccttgcctattttcgtgagaaagcaaaactgaagtatcacaaatgggactgcgtttaccagcattttgaaaagtttgtaaacggctattgtactttcggcgatgtaacggtagagctttgccagaagtttaggcagtatttactgaactgtaaacaaatccgtcatcctaatatcagcgtttcgaggaattcggcagctggttatttttcaactttccgtgcattactgaaaatagcttatcaagagaagatgctacgtgaaaatctaaatgacttcatagacaagattgaatggaaagaagtcaaaaagcagtatctcacattagcagaagttaagaaactggccgctacaccatgcaagattcctgtactgaaacaagcttcattattctcctgtatgaccggtcttcgtatcagcgatattttacagcttacatgggataatattgaagtcggtcctgacaatggctattacatcagaatttgtacagaaaagacagagacggaagccactctccccatcagtaacgaagcattggaactatgtggtattcctggttcaggccgagtatttaaaggactgaccagagctatgacgaatcaacctctcaagcaatggatttcggaagccggaatcaaaaaacacataaccttccactgcttccgtcattcgtacgccgtcatacaaatctctttaggcacagacatttacacagtatcaaaaatgcttactcacaaaaatgtttcgaccacacagatttatgctgatttggtcaattcgaaaaaacgagagacagcgaataagatttcgttgaaataatataactcttatcttatctataacaggttatatctgataaatctatcggatatgacctgtttttatgtttgctttatctgacagaatcgctatctttgaagaaaattgagtctttaaatgaataactacagctatgataaaaatatatggaatggaaacttgtccggattgtacgtatgtagaagaacaagtaaaaggtaataaccaatatgaggtcatcgatattggtcaacacgtaagagatttgaaagcattcttgagattacgggatcatcatccagcctttaatgaagccaaaagtgttggagccgttggaattccttgctttgtattggaagacggtacagttactttgaatccagaagatgccggattacgttcacgtcctattaatgaaggagcaacatgtaatattgacggaagcggttgttgattatggtacagaaaattcttttccttcacggtttctttgcatcaggtacatgtatcccagcgcttgccttgaaagaatatttcagcggtaaggcaacagtcttgagtccagacttacccctgcatccacaggaagctctcgactttatccaaagattgtgcaaccaagaacaacctgatatattggtaggaaacagtaatggctcgtttttggcacagatagtagcatctaaaaacaatatccctgctttactcggaaatcctcatttcgaaatgacacgcttcttgatggaacgtattggttcgcatgaatacaaatcaccacgagctaacggaaatcagcagcttgtcattaaccaaacattgattgatgaattcgcagaacttcaacagcatcaatgggacaattgtcaggtagctaaccaagaaaatatatggggaatatttggtgagaatgaccatctggcacactttgagcctttatttttaatgcattataaatattcataccactttcctggcggtcataccccaacagctgaagaagtacaaaagtattatgcgccattagcggaacgattattagaattatagcataacttatcatataatatagaaagaataccacttttgtttattatatgataagttataacaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgttataaattcatgtcttatattcaatcccataaattaatccgcccctatctcatctgaacacttcttactttccaataataatcaaactatttatgacaattagtgacgtttgatgaagtctgatgtcactcttgtcattttctgataatacataatcagtaaacattacctttgcttatgaacagttaaacatatggcttatgtatttgaagaaatttgaatattttattttagattctagtgtagctggaacattacttcttatggcacttgctatacgcattgaagcaatcaatgcaggctttgatcagttcagctcaaatattatttttatatcggtctttataatacaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgattataagaacaaaagactatctgattttataccaccaattaccaaccttacataataaatacactcccaaacgtttattattagaagtcttaatttttcctttagatctttaactaacaaatagatttctttatacacttgtgatcattcattttcaattaaatgaatattttcaaaattatttcacaacatacaccggctgaaactttgacccaacattcttcaacactccctcctcaagcagccgacgaatataccttgtcgccttagactggttgaatcccgtgagctgttcaaagtcacggcgctggagaaaactatgtcctgaaaagaattctgtgagcttctgtttcacctcttcgtcgtccatctttgaagaatgtcgggaagaatctgccgaacgttcaaacttcacctccttgaaacggtccgccagttccttatcgggagtaaacttgatgcttcgtacacgaatatcggaagccgttatatatttcggattaatgtcgggcgtgcatttcagacttaaactgaaatagccgataccttccaagtgtacggcatatccatcgctcagcttctcgtaaagctcatcgttcaaggccgtgataacggctgctacatcggcaggagccaccgtacattttttagagatagactcacgaatttcgtgggtggtaacgacatctttagtaattactttcgcatgtagttttggagaggacacaccctctttcacagggttctcaaataaatcgaatttaacagccatatagtatcagtcggttagttaatattttatcaaacgtctttacataaaagcttcatcacgtagctgcttagatatagacacgaacgtgattagctatcggcacgaacgtgttaagatatcatcacgtttgtgtcgaggtaaatttagttataattttgaatatatacaaggaaagctttgtttaatccgaaaacgaataatatatccttttcctgatattcatttcctcatatatacgcttaattttttctcaaaaaaattcaccttttattattatatcacgcaaataatcactatttttacaaataaataataaatcacatgcagaccgttttcgacaaacaagatctttttctggcacaaatgcgtaaagattatgccttgggaaaaatccctcataatgatatcttcaaaccctatttcgactggaaaagtggagggccattaatctatacctccgttacccaatcggatgaactataataaaaacttgaatatatttaacaattataagtatgtttatgcatatgtataatgaaaactcgtcgggcctgactgctcagtcccttgccgcatggcgctccctccgcaggagtgattatggttttactgatataaatccatcaacatatggcttatcttgtgtaacaactgcaaaggcctgtcttaccaatttattggcgacagcaacaacagctactttaccaggtttacctttagatcgtagacggtcaaaacatgctttacattctgtattgcacctaagtgatgagaatgctgccacatatagttgacttcgaagaattggatcgccatttctgtttatgtgacctttaaagttgacagatgttcctgactgttgatatgttggtgataagccaagataacgcgtaagttgttttgcattatcaaagtatgtaaagccaccagttgccacaattaaagccgcagctagtgttacaccgataccttttatggaagtgagtaaatccatctgtttcttgaattcatcattagctaatgaagccagttcttcttccatatatttgatttgttttcccagaaaagcaatcgttttctctattgttttcttgcatttagagtcataaattggaagaacctccatagaacctttcaggttgcttgttgctactaactgcttctttagctggcgtaggacagtacgtttttgtttgagaactaaaattgaatcgctgcgcattctgtatggagatggttgcatcttctcaccgtatagtgctataagacgtgcatcaatctcgtcagactttatgactgaaagcatgactttggagaaattttttatcttcagagggttctccaggcttactgtaaaaccaaactcggaaagcatatatacaagcaatgtactataattgcctgttgcttccataacacaatgatgttcatcaactgatatcgtttttataaactcacgaatacctttagctgtattcttaaaggttttggttttactgctttttgcagaagaataagcaaccacgaatgttaacttactaacatcaattccaacgtaggtcataagctaatggtttttataattacaacgcaacatctatacatctttagccatcattgcaaatgcggggtctaactgcccaatgaactatccggattctgatgtaaaagtgtgggggctgaacatccgatacaatctaaatgactaagcttacgtcggtcttattccacactttgatgttgaaaatttatacaaaagtacaacgtttaattaatatacaaagcttacgatatcattcaaaaagcgagggatgtattgtatgatttctacgaaatgtatccagactcctataaggatataccattatccaacagcgatgatccttggttagaatacacaggatttggaaaggataaatatattgtcagttatctggaagccctcgaaaatgaaatgacaaacttgctggtaggaggatttttcaatgagtaaaaggaatgttatagttctcataaaggaaggtaaatatgaattctatggttcacccgccgcactttattcaagacatacggcagaggaactcggaattactcaaggaggactaaacaattacttttgcacacttcctaaaaatacatacaaagtatatcgaaacagcaaatgtgagatagttaaaggaattataatcaccaaccagaacaataagtaaccccacctatggatgtcctttccaaagaacaacggcacaaaaacatggctgctatacactcggccaacacgaagccggaaatgatagtcaggaaatatctgtttgcccacggattcagataccgcctgaaccatcctcgcctgcctggccgtccggacatcgtactgcgaaaatatcatacttgtatctttgtcaacggttgtttctggcacggacacgaagggtgcaaatattacgtcatacccaaatcgaatacagagttctgggcaaacaagatcaaccgtaatattgcacgcgacaagaaggtgcagaaagaactggctaaaatgggatggcattgcatcacgatatgggaatgtgaactgaaaccgcagaaaagggaacagacccttgtatcgctggaatatacgcttaatcacatctatttaaaagatcatacggtaagctattccataaacgaggaagaagatgtgctgatggctgcggaagatacggtcaatgactacacccctactcctaaaaagcagtaagccgtctcctgctattcatactctaagccatcatggagtttcaatgtttctcccaaagcctcccaaaccctaaaaaacaaaaaaaccgaacaatcccagaacattcttcatcgttcattttttataattaaaaaagcactcgttatgaatataaagaaattattcctttgcatgggagccatactgacgctgagcttggtaaccatgtgcgttacgacagtaaacgacaatgccggaaaagaagaaacggtaatctgccgtggtcaggaagcgcatacttccggtccgatggtgaaagtgggagaacaggcacccgactttcgggctacgaatgcggatttgcaagatgtcagtctgtcgtctttcaaggggaaacggatcatcctgaatatcttccccagcctcgatacgcctacgtgtgccttgtctgtccggcagtttaatgcccgcgcttcggaactggagaacacggttgtgctgtgtctgtcgatggacttgccttttgcgcagtcgcgtttttgcagcaccgaagggctgaacaatgttgttccactgtctgttttccgcagccacgatttcctgaaagagtatggtcttcagcttgccgatggtccgttaaagggactgatggctcgggcggtcatcgtgatagacgaaaccggtaaggtgcgttatacgcaactggtaagcaacatttcgaacgaacccgactatgatgcagcgcttcaggcggtaaacgacttgtaaaaacaggaaatttgtcagccgttcatcaaaaaacctgacaaaaagttcatatcgaatattggtaaaaaaaattaatttattatctttgttcgtatatgaagaaactacttcacatattccccgctctgctggctctttgtctgtgcgtttcttgtaagaatacccgggcaaagagccagcggattatgcccgtcgagatactggctgatggcgatcttgccttccggcgcggcacaggcctcttgagtcaggtggtaacttctgccagcaaagacggggtttactcacatatcggtattttaaaaaagattgacaacgaatggttcgtgatccatgcggttcccgacgagcctgattttgagggggatcctgaccgggtaaagatggattcgctgtcgcgtttctttgctgccgacagggcggtgcggggtatgatagccagagtgacagacgattctctggcggcttcgaaggcggctgccatcgcctggaagatggcacgcgaaagggttctctttgaccatgattatgatctgacggatacatcgcggatgtattgcagcgaactggtggagtttgcttaccagaaaacgggtatctgtctttccgaaggcagacggacgcaaatccatgttccggcaatgggcggcacgtacctcatgcccgacgatatagcacgcaacaagaagctgaaaattatatacagtttcccgtaaaattgagctttttctattctaaatattttatttattaatcttaaaaatttaacgctatgatgaaacaactgattcgtttcgcactgatgctggtagctgttcttgccttggcatcgtgtactcccagcacaccgggagctgctctgaaggagtatatgtcggctctgagcgacaaggattacgaaaagtttattaatggatgcaacatctccgaaaaggatgccgacaaggcgaaagagatacgtgagggacttgttgccatggttcaggaaaagggttccaagacaattgaaaagagtggcggactcaaggaaactgaaatcgtgtccgaagaaatggccgaagacggtaattcggccattgtgacattcaaacagcattatggcgacggcagtgtcaaggaagacacgcagaagatggtcaaggtcgacgggaagtggctgatggacattggcaagtagtacgggatctcagttcccagaaagctacagcagaggcggctgccacgttcagcgaatcgacgccgtgccacatcgggatgcggactacataatcggattccgacaggacttcggcgggaaggccgtcgccttctgttcccatgataatggcaagacggggaatgtccttcagttccggataatcgatgggtacggaacggtcggtcagtgccagggctgcggtacagaagcccatttcacgtaaggaggctacgggacggggaagccacgtccagggtaccagaaacacggaacccatcgacacgcgtacggcacggcggttcaagggatcgcaggagtcgggtgaaagcaggatggcatcgatgcctaaggcggctgccgaacggaagatggccccgatattggtggtatcgactacgccgtggatgacggctacccgacgggcatcgcggcagacttcttcggcagtgcgtggagcgggacggcgcatggcgcacagtacgccgcgggtcaacgtgtagccagtcagtcgtgccaagagttcccggctgcctgtatagacgggaatatcgcctgcgcgaaggatgatgtcggcggcatcgcctgctatgtgtttctgctcgcaaagcaaggcaaggggctggtaaccggcgtcgagcgcgacgcggatgactttcggactctcggcaatgaagatgcctctttcggggtctatgcggttgcgcaactgagcttcggtcagggttccgaacacttctactccggggtgttcgagggaggtgatttctattacaggcatgtggatctcttttttcccgccaaagttaagaaagaatatcggccggagcaacgtttttttctctacctttgtccgtgaaaaacaaattaaagactaaaaactatgctacattttgacacggactatatggaaggggcacatccggaggtgatgcgccgcctgatggaaacgaatctggaacagactgtcggatatggtaatgatgaatatacgcgccatgcgcgcgagctggtgcgcaaagcatgcgggcagcctgaagcggctgtatattttctggtaggaggtacgcagacgaatgcgactgtcatcgacggactgcttgcgcatcacgaaggggtactgggagcggaaacggctcacatcaacgtgcacgaggcgggagctatcgaggcttccggacataaggtgctgacgttgcctcaacacgagggaaagctgcgtgccgatgaagtagaggcgtacattgacaatttttaccgcgatgaaacgtatgaccacatggtagcgccgggaatggtttatatctctcacccaacggaatatggtacgctgtattcgctcagcgaactggaggctctgagccgtgtatgccgtaaggcgaatattccgctttacatggacggtgcgcgtctgggatacggactggctgctccgggtacggatgttaccttgcaggatattgctcgcctctgcgatgtgttttatataggtggtacgaaagtgggagcattgttcggcgaggctgtagtggctccgcatgcggaacgtctgccgcatttctttacgctgataaaacagcacggagcactgctcgccaagggacgtctgctgggagttcagtttgaaacgttgtttaccgacggactttatcagaaaatgggagagcatgctgtacgtctggcgctgaaactgaaacaggcttttgtccagaagggatacaaacttcatctggattcgccgaccaaccagcagtttgtctgcctgccgaatgaagacatcgaccgtctttcggctcatgcgactttcgaactgtggggaccgcgcggagaaaaggaaacagtggtacgcttcgttacaagctgggctacacgcgaggccgacgttgatgcgctgattgcgttactctaaatcgtcgtcggcttcttcgatggaaaactggtttacggtgacggcgatagcatattttatcagtccgtcatcggaagccagcatggttccaccgcttcgtatgcacatacgtaccgccatgccgtcgtttgccgtaagcaggtattcgccggaatgctgctgctcattgacggtaaaccacatgccgttttgcccgtattgcacttccacgtagatgccgtcggtttcataatcccacgaaatacggtattttgaagttgtaccgcgatgaaaagtgaacgtacaagtcgactcgtcgtaattgatgtaggaaagcgtggtgacttcttcgggataaaagttgagggctatgcggctcaccgtatcggttgtcagcagattgtttacggcatactcggtataggtttcacccaaatgtttcttggcgatgggataataatcgatggtttcgttctggcaggagccgaaccagatggcagcgagtatcatcgctaccatcccataaattgctttcttactcattcttcttctgttgcttcgttctgcatcatatcaaacggagggacttcttcaccgggagcaggcttgtcggctttgggcatgggacgtggagccggctgttcgggcttcatcgtcagccagaggtcgtactgctcgtcggtcagaattttgcgaattttcttcattcgtttttctgcgcgttcctccatttctttctttttctcttcacgatcggcgggaggtgccatcatcggacggccgcctcgtcccatcatagggggctgaccatcgccacccatcatcgggggttcgccgccgccgttcatcatcgggggacgaccgccacccatcatcggagggcgaccggctcctttatcgccgcgacctatcagggcttccagtttttctctctcctccttcaggttgagcttgtagattttcttgtattgtttttcggtcagattaagcactttatccatttcgtctgtccgcttgcgggcagccttttcgggattcggaatttcctttgccggagcttgtttctcctgttggggttcgtcggcaactgttgtggctgaagctgtggaagatacaggcagcagcgttgccagacaaagaacacatacgattttcttcattttcatcttcaatatttttttaagattcttgttcaggggaacaaaggtaagccgggcagtgctttccggaaaatagaatcagctaacccgcttattctctcggctaactcttgctaaatcagatttacccgatagtataaagacggtaaagcaactaacagataaaattagtccacttggtctgcaaaatcattccattcgccgattttagttgcaccgggataagcacagacgtatttttgcagacatgaaaaaagagtgaagcacgacaatgaaacatctacaaaaacaattacttctggaacagcttatttatgcgacgatctggatattgatactgggaacgccgcttatcagtttcctgctcgacgatgaccgtccgatggaaggggatgagctctggaaggaggttagcgatacgtggctgatcgttctccccttcttcctcttgttcctgatacataattatgtgcttattccgcgactgttgctcaaaaagtattatacgcgttatgtggtgtcgcttatctttaccattggtattctgtttttgtacctgccggaatgtattcaggtattacacccgcatccggatttccggccgcaaaaagagtttgttatgccggattcggcacctcatgtcctttttcccgaccgtcctccggtttctccttcgagcaaaaaaatgatacaccccgcccgtcccatacatccgcctttcttgctgattcatattaccgtggccatcttgctggtgggatttaatctgactttccgctttttcctcaagtcgctccacgacgacgagatgttgaaggagctggagcatcagcatttggaatcggaactgcaatacttgaagtatcagttgaacccgcatttcttcatgaatacgctgaacaacattcatgcgctggtggacattgatgcggaaaaggcgaaaaagaccattatcgagctttcgaagctgatgcggtatgtgctgtacgaagcgaacaacagccagatttcgctggaacgtgagattcagtttctcgagaattatatcgcactgatgcaactgcgctataccgacaagttactgattcagaaggactttccgctcatcgtaccttgcgtacagattcctcccctgctttttatctcgctgctggagaatgcgttcaagcacggggtaagttaccgggaagagtcgtacatcgaagtacggatcgcgcaggtggacgaggggatcttgtttgcctgccgcaacagcaagcacgcctgtacaaaggatacgcaccacggtataggcatcgagaatataaagaaaaggcttcacctgctctatggcacgaactatacgtttaccattaccgaagatgaagtttcttaccatgtattacttataattcctccgctatcatgaaatgtctgattatcgacgatgaaccgctcgccctgacacaactggcgggctatattgcacgtattccgttccttacgctggtggcttcgtgccaggatgcctgtcaggcttctgaaatactggcgcagtctcctgtcgacttgctttttgccgacatcaacatgcctgatttgaacggtatcgattttgtccgctcgcttcccaatccgccgatggtcatctttactacggcttattcggagtatgccatcgaagggttccgcctcaacgccatcgattacttgatgaagcctttcagctttgcagaatgtctgaaggcggccgagaaagcccggaagatgtatagtctgacgcacaatgcgacggatacagaagaggataaggggactttgtttgtgaagagtgaatataaggtggtacggatagataaggagaagattttgtacatagagggtatgagtgaatatgtgtgcatttatctggaggatcgcccgaaacctgtcatcacgctgaacagtctgcaaaagttgtcgaccatgcttccgtcgaacttcatgcgggtgcatcgctcgtacattgtcaacctgagcaagattaccgagatttcccggttccggattctcttcggaaaggatgtgtatattcctatcggagaaaactataaggagcagttcatggcatatattcatcggctgggactgatctgacggaagaaatggctatctttgcagcgttctctgaatacaaaatgaattgctttatggaaaaggaaaaagatgtacattcttgtgtggactgcggcacacagaactgtaagtacaaggaccggacttatcctgatttctgcctcacgacgaacttgaaggaagaggatatgcagtgggcgctggaacggtacgacgagggggataaccgccgggtgatgattgccagtgcggaagtggaatacgaggggtactgccagtggacgcgtgtgcaggagatcatggagtttgcccgtaagatcaatgcacaccgcatcggtatagccaactgtatcggactgataaacgaggcgcgtatctttgcgcgtattctccgggcgaacggtttcgaagcgtactcggtgatttgtaaggttgccggcaaagccaagagttcgatgggtattccggctcaatgtgaaagcataggggctgccatgtgcaacccgattttacaggcgcgtctgctgaacgaggcgaaaacggacttgaatgtggtgatcggtttgtgcgtgggacacgacagcttgttctacaagtatgccgacgcttataccaccaccttggttaccaaggaccgtgtgacgggaaacaatccggctgccgcgctttatactgccaattcgtattaccggaagaagttctttccggaagaagagaaaaagtaattttcaaatccaaatatcatcgtgtataaaaaaagtcaatcggcctgaactgttttcagaaaggctgattgactttattgtttacttcagttttttaccgtcggaaaaggccttgcctactttcggaccgatttccagataatccaaatgaaccggatcgaaggtgatcggtctcagtttggctatatctaccttgccgtcttcgcccaatacgctttcatcgacggatacattgacgatgcggccggtcatgtaacaggtttcggcatcgtacgatacaagctcacactccagtgtcatgggaagctcttcgatgacgggagcattgacaaaagcagatttcacggcatggaatccggcatgtgcaaacttatcgagttctttgttgcccgacacgatacctacatagtcgcattccgttacgcggtcggctgtacccatgctgacggtaaaggcacgtgtcgcaagaatgttcttggttgtcttatgtccttccgacagacagatgcctaccatattatcggtatatgtacctccccatgcggcattcatgacattgggaactccattttcatcgtaagctgccacgataaatacgggcatcggatataaccaggtttttactccaaaatcttttctcataggtgtttactcctttctctttatctttaatggttttcaaacgattttcttgctttatgcattatgctactttgtcctttcggtaatggctaccttgatgactccatccagacggttctcgaagatgcggtaggcttcttctatctggtcgagcgggaaacggtgggtaatgagcggtgtggtatcgatcttaccctcggctatcaggcggagaatctcggcacagtcgcagccgtccacgccaccggtcttgaaggtcaggttctttccgtacatgtcgggcaacgggagtatctgaggatgatcgtaaagtgcgacaatggtcacaatggcattcggacgggcacactcccacgccatgcggaatgtctcgtcggttcccgccacttcgatcacgatatcggctcctccatgcgcactgagtctgcgtacttctccggcacatgcttccggccgtacaacctgcacatcgggatagtgctcacgaacaaagcggatgcgttcttccgactgctcgcatacgatgatctgtttagggtgtttcagcattgtacacagcaaggtgcagatacccgtagggccggctccgataatgagaacggtatcgtcgggcgtaatttccgagatacgtgccgcccagaatccggtggcaagaatatcgcctacgaaaagtgcttgttcatcggttacgccttccggtatacggttcagcccctgatcggcgtaaggcacccgtacgtattccgcctgtccgccgtcgatgcggcagcccaaggcccagcctccgtgttcgtcttcgcagttgtttacatatccatgccggcagaagaagcattcgccacagaaagtttccacgttgaccgtcacacggtcgccgggcttcacggtggtgacctcctcgcctacctgttctacaatgcctaccatctcatgccctacggtaatgcccggcacggcacgagggacacttccatgcttgatatgcaaatcgctggtacagatacttcccaacgtgacgcgcaccacggcatcacgcgggcctttcagttccggcacgggcttttctatcagcgaaaaatgtccgtgctctatataggtatatgctaacataattttgattttttagtctattacttctatcagaaaactcacgggacggaacccgtcgttgcacgaaatcatggccgaacgttcatttttcatccagccgtcgtagaaattgctgcctccatgagccagtgccatgacgaaaggcgacatgctctgccacgcactttcacagagtccttcgggcttctcccagccattggctataaagacctgcccttcttccatatcgcatgcgtgttcgatggggttttcgtattgctccatcaagtcccgatagcaggccttgcgcatgacggtaatgcggatttttttcatttctcctcctttcttctattcggaaaataggcttccagcacttcaccgaacacatcgcccggcgcaatctggttgaacagttccatcgatgtacgaagtttcaacacatcaacctccgatcccatcagctcgagcacgctacggtgtccgcgatgtgccagcaaggcacgggatatttcccgcagacgcgtacccaacaccggatgctgtaaatacgcacgagcctcttcttctccatccagaccgtagtactgtgagttgtaactatatcccagccccttctgctgaggaaagatataccaaatccaatggctgcgcttggcacctttttttatttctttcaaggctaccggatacatgtcttcctgagcatccagaaagcgttgcagattaaatttcgtaggacccatattcatccgtttttttatcttctctcaaatgtaaggattatctcgcaatatgacaaggtttcaggggcttctttacaacctttcaaagtaggtcctcttacctaacaagtcaaacacagcttcgtttcagaagcttctttatgcctgatctaagacctgtgatccgtttttttgttaaaatttaatgacaggattgtttttattcacagaaatacatatctttgcttccgaacctctgcttcgtggaggctcgtcctattatacatagatttttatacaacaaatgttcgttaaagatgtcacacaaagcgtttattgcgttccgctaaggtcctgaacgggattttacttagcgaatgaacttgatgaatgattgcttctgaccgggaggccgggattgttgtgctctttgacgtacgagctgccaacctctctttcaacggggaaacgagaggtactttctttttctgcggactgcaaaagtgctgtgcgcgggaagatgttatgctatctgtttttttcacttaaaaaatcatttgttgcttatgaaaaatcttatgttacgcgctatgcgcactctcgacgaaagtatttgtgctcctgaatatgccaacaatcagttgactatcgaaatgctgtttcctgaacctcctgcttccatgaatgaattgtccgtacaggtctattcgaaggactatcgactgatgggagcggatgtctatactccttcttcacagaagattcctcgcaaaatacgctttacggtgctttcggatacgtactgggacgatgcggaatatcgtgtatttgtctttctgaacggacttccgaaatggattgcctcgctcactccctcacctttctatgaggtctgggagaaagtcagattggaagaactctggctgcatcccaatccaaagttctttatcgaacgtattggtacggccgactggtggcaaaaggtttattccgaaaggtacgattttccggctcccgaagaactgatcagtaaatttcgtatttatgcagaagccaaagatgcttcgccgcatctgctgattacgggaaaccgcctgatggcaaaagctttcgcctgctttatcttatcgccttttcttaccggtgaggatacacctgaacggcgcatcttctctctcggtaacctgatctcggacaagtcgcaatggaacgaactggcaaaggctatggaacagaagtatgtcatcgtcatgtatgttccggaactggaatacaatgcctgtacagtgaacttactttcgatgctgggcgaccaactcggcaaagagggcttcaaccgtccggcctttattttccacggcacggaaaataatgtaagacagctcctcgaagaatgtccttccatagctgaactgtttactgaatacagtacgttctgcctcgacagctcaaatacgaaaacgctttcgcacagtgagctggaggaattgcttccgttgcctttcgatgacgcagacgtgaaaccggctccgacagaaacgacggccatggaatattccgccgaagaagaacttcggcagatggtgggactgaagcagctgaagaaggagatactggaagcacggatgatgtcgctcttcttaaaggaacggagggaactgcatctggaacggcagactgaaagtcgttatcacatgcttttcctgggaaatcccggaaccggaaaaacgaccgtcgccaagctggtgggaaaaatgtatcaccagataggattgctgtcgaagggtcataccgtggaaacctgccggaccaatcttgtaggcgaatacttgggccagacggaaaagcgcatgagagaggtgatcgacgaagcccgcggaggggtgttgtttatagacgaggcatatacgctgatggaaaacgacaacgactcgaaggattacggcagggaggtgatcaatgcactccttacgatattgtcggaaccgaatcctgacatgattgtcatcctggccggttatgaagataagatgaagaagctgctcaaaagcaatccggggctgagggaccgctttccgcttcgtttccatttcgaggattatacttcggatgagctgagcgaaatagcacaccgtatcctgaaaaaccggaattttgttctgactcccgaagccgacgaacggctgaaccgcctcatcgaaacggaaacccggcagcgggatgaatacttcggcaacggacgctgggtgcataatctgatagaacaaggtctgatcaagagtatggcacaaagagtgatgacagcgccacgtcctcaagccatgctttatcagttgttcagcaccatagaagtgtgcgacgtggaagccgtcgagacatccttcctccatacaatgaacctgagtcttactcctccgtgccgtatcggattcagggcataacgaatggatcatccggactattcctgtgcaacgaaatgaatcttgaaaaagcggataaaaaagaagtcgtatcctcattctcccaagagaattggatacgactcttcttcatttaatgtatgctatgattttaatgctattgatattagccaataactacttcgccatctactgttgcctgatctccccaagaaccgatagctccgccttccacggttatcttgtccttacacaatttcagggttaaggtaatcttctttccacccaacaaagtttcctgaggcattttcagttcctccaaaagtgttttcaggctatattcctttgtcagctgatttatcttgactgacaaagtcacatcggcagtcggctgcggcacaaggtagaaagaagctgtggtaccttccttctcaaagcttgctacttccggttttgtactcttaatctttcctgaagcaacatctaccacacaagcagctttcgccttacaagtagtaaccaaagtcttcaactcctctgcagtgtaatatccgtctgagctgaaactgatattcagcaaatgcatggcatgattgaaagaaagattgacagggttgggactccctacagtcaccttttgcgcttcagacagcaacaaatccttatattctgatgtagaagtattaaattcgaaagtaccgtcattgcctaattcctgcttcggatagcatgccgaaaaagtcacttccgaaacgcctcccggtaatttcaaaccgctccatgacatagaagtagcacccaatgtatacgtagtagagatagtattcatagttcctgccacaaaaatcgacaagacatcatcctttacaaaattaccacttccgtcttccttcaagtcaggcactcgtgtcagaggagctacattggtcactatcttgattacatcattccctgcttgcggtgtctctacatccttctttgaacaagaagctgctaaaattcccgccgtcaataatacataaactttgttcattctcatttttggtttttctatattcaacgattaaaaccaagaatggttcatcgtttttacgaatatttcaatatttattcattttgagatttcctagtaagatcatttcagcctccaacttttatattctcagctgagatatgtccacaagctgaaatttaaaaatgacagatattcagccattttattatgcgatcattatcggcttgatgaataatacctcatctcagataagaaggtttcattgtatcataattagtaccttcaaatgtcaccttcggagagttggtatttccaagtccggtaaggaattccacataatctttcaaataaatattggtgaaaggagcatcattccaggtatcgggtacatattggatgttgaacataatcatcgaagtctgaccagcttttttctgtttctgcaaagttgatcttctgttttctatacgtccaatcacactaccatcagaagtactctgttcccagaatctggtaacatgtttcaaccgtttcgcataaggttcaacctccaggctcatttcaaaggaagccactccaaatttctttttggcaacttcgccatccattcctgcaatccaggtggtctttgtagttccttcggctgagttattgtaattatctcctctttggtagtttgcattccatacataatccagcaacgtgccgacctctatacctgccagttcgtccaagacagactggttttccggattccgaacccattcgcgtaccgctttccggctttcactgattttattgccataattatccatatctgcccattttttctctcctttctttatctcatcgaaattattgctgaacagacgccatcctcggtcacctaccatcgcattgctgtagaaaccgatgttgtacatcgttatgatgttattccggtctttccatggctgcccttcaatgtacggcattagatctctcagttccttgataaggaaatgaaaacttcccatctgtaccattggtcttccgggctgaacagattccaacgcctccggatagtcggcatattcatcatcgaacatcactccgtcaagtccgtactttctcacagcttcataaatatcccgggcaaaatcttttaccatcttccgcccattgctgatatcaagattggagaaaccaattccctgatgattaggtatgaccgacaacaggacttttatttcctttttctgtaaaggccttacaaagatatccacattatctaatatgcgtttcatgttatcattatacgccagaaccggttttcctgagaactcatcaaaattcatgtttgcagaaaaaatgacagccatatcaaacaacggtcgcttcttctccggttgactctcaccataaggataaagcatataattgccaatattacgcaagtcattctccgcagcctctacaatggcaaccattctgggttctgccactgtcggagttcgatctgtccacgacatatctattgctgttgtttcaagattgactatctcgacaaactgtacgccgatttccgctccaccagctttcagaaccaaaggaagaacgtaagtaccattgtctgtatgatgaatcttgacaggcaccgatacactgctttgtcctttttccagcacaacagatgcaggtaacgtatattgagatttatcaagaagcttatacaaaccgatacccttgaaatctgcatatttcttggtcagatcggccaagacttcatccgaagtttcaaactcagccacaatatcctgattactgtttttgccttgtcgcagttcaaaaaccatttcttcgcccgacaatctgtgagtaatattgttttctgctccgggtaatacaaactgaggctttcccatcatcagagcattttcgatctcaggtacttcggccgtcagactttcttccttacaactacagcagaaagccgcaacacaccctattataatgtagaaggatttatatagtttcatcacctttttcttttaaatattaatatcaatatcattatcaatcactaccacgggagttacagattcatcagtggctccttgccgttttactgtaaggtggcatccgtttccacttacgtcggaaatcttctgattacccgatccaagcatcactttgttcattttccagtaagccagcattttactcttttcaagatcaaactgtatcacatccagtgcattgtcttttaattcctttattgttctggaagttttccatattctgacttccgacattttgccgttaaatcctctccattggttaaacgactgtcccaaccggaacgaagagccagccagactaatatttccagtagaacttatggacaaacgttctctatagtttatatagaacttaatatctgccccatcgtaagtcatggcaatatgataccactgcttttccttgaacttataattgatgatgtatttcttgtcattaacaataagctgtagcatgttagtagaaacacccgcatcgccaaaacgcagcaaaaaattcacggttccaccattatcctcgcatccccacaacgaagagataccagcaagagttccctccgaacgttcgctttctgccttaaatgaatccacatagataagtccctcaatcgtacaagcctgcaagtttttgaaagaacttccatccgcttcataatacaggttgtttctgttcactcccttgtcaaccccattggcatccaacgtattgtctccagccataggacggaaatcggcggctccttccatttctccagaacctcctttacgctttacgtgcagataaaccactttgttcgtttcagaaatatggaacccggttgtagcttcgagttgtatagccagcacataatctttattaatttccaatgagaaactattaataatacggatggtacaactattgactgcaacctttccatctctttcgaacacgaccatgtcgttctccaacttgtaggctgcctcgggaaggaactctgccttataaccgacatgggtcttaaacgcatccagtacagcctcatccttcaatacattcaaataaaaaacattgtccgaagctatcttaccatctcttaattttgccgataccgtaacttccttagtatagcctataggctgtactgaagaaaatattacgtccaccggatcaagcgtcatttcccgtgcagaagaaatatccgacgtttccgtcgtattgacaaacaccagctctctgtctgttagaatctccggtgcaacagtcttatctggtccaaacaaagtttttccgaattcttcacggcaagccgtctgaaacaacagcagcagaagaaaacctattatcgataattttttcatagtatttttattttaggtttagatactgtattgtctgtctcaagacagaatatttattttcgtagtcattttctactcctctcaaagccataccgcccgttctttctcctgtcagcggcttccataggctcagcgatttgtatttcgcgtccataacagcaacagacgacaatatatctttatagggcactttccaggaatcattctccagcgacagataagaaaggaactgttccgcacgggcattttccatagacatgaagctgttgaacaagtcctgtacctcagaaagcctgtcgttaccatgagtggtactgatgacataatcaagccactggcaactgttgcttacatatcctatataaccgtcgaaaacaagtattctttttgctgtatgaaactttgcaccggccgtatcaatgaatctcttcacgacttctctaaagaagacatccccagtagaagacatactgatactcagtccatccagtcctatctccgaaattattttttccgaacggtcaagcagcgtgtttcctatggtagaatagtgatccatcaccttctgacgttccgtttttacagcagcttctatatctcccatagaaacttctcgcccttcgctggcggcctttgcttcagccatactctcacccttccgttctgcttcatccaaagcaaccacatactgctcatagatcttgtcgaaatccgccgtcatcagcacctttgttcccttttctcctctgacacatcgtaaatcggccttttgtgcatcagacagtgtatcatactctcctttcagaataatcatatcaagactatccggcaacgtacttaaataagagttcatgttcccgtccgccttccagtttgaaaaccatacggcagatatataatgctcagtcgatttatagtttttgatttcagtcaggtttctgtctgcggaatttactaccacaggtagaggttcaatttcggtacagccaacaatcagcagacccagacctgctatttttattatatttttcatatccatcttttttatattgacaactatcattttcgtgcccaccatacattagtattcggactatcattaccttccaaatcttcctttatcgcatggtccacattagtagtattcaccgaatgttctatctgcggcaaaggatatctccggtaaccattggtatctgccccggactcatcctttttgatgttgtttacttcgtggttatagttcacagccggcatcagatttggatatccggtacgccgccattcggcccacgcctcggcacttccataaggaaacatcgcaatatatttctgtgtaatgatctgtcctaaattgtctttttcattatcagaccacttcactgtcacattcgaagaaaaggcaggactatcgaaagccggatacctaacgtcagaaaaggcaccacgcttggaagtattctccaaataatttcccatagatacattatgcatattcatcgacagttctattccttttacatacagttcttttgccgaaccacccatattccatttctttagtgctccttctgccctcaggaaagaaacctcggaagcagtcatccatactacagggtctgaaacggttactttcggacgagaataaatgtttgaagccgcattgatcagttcttctttagccgggacagctactcctgacctcaaaccaaagtaaacatcatttccacttctgttcgttttttcaaaataagcctcccgtcgcggatcggaaaaagcattcatgtaagaaataatatctgctccacatcgggtatctccccagttattactcatcttataaaaaggattatcagaggtaggtttcattgcgttctcggcattattttcaatgacacctgctcgaacagcttcctctgcccattttttcgcttcgccaggtaatttatgtgacacccttacagccagcctcaacttcaaagagttcgcaaactttacccatttagcaaggtcaccgttgtatacgtcatcatgcgtcatccatgcacttttttccaccgatgacaatactgcctttgagagcgtttcaccagaccaagtaagttcctcaatcattttccgatagatatactcttgtgtctgatatggcttttgagcttcagttcccgaaaactcatacggtataggtccatacatatcggtcaacctatgtaatacggctacctttagtattgtaccccatgcataaaagacattatcatggcttgcattagtagccaaagccaaagaattgtattgcttgatgacttttggtaaagattgttcatccgtaaacggatattctataaagcctacattataattgaaacgtcccaaatcagtatgtttcgtctgtcccatataccctgaaagtgattcacagcccagactcatggaatactgaaacagattttcctgcaaaggaatcacaataccagacagaactccgcaatcgttggcaacctgttcggctatgcctccagaagcaagtacttcatccgatactccataaggattactattatattctgcaaaatgatcagtacaacttgcagcaaacatacctgtcaatatagcgaataaaaaaatcttgttcatagtttaaatatttagtccattacagattttaaaacttagcctttatgctaaaaccaaggcttctcaatgaaggcaacataaaataatccaatccctgcgcataattacccgtagatgaaacagactcaggatcgaacggtgccttacagtaaaacatcaacagatttttccctgttaaagacaaagacaaatccaagacattacccagccattttctcggtatgttatacgaaatgtaagcctcacgcaaacgtacattggaagctgtataagtataatattgtgtcagataatctttaggtctaccctgcaactgatagtatgactgtgctggaacaacaactcccggtgacaaggtcactcctccagcatcacgggcatcggccgtaactttcgacacacctgaataatccatcgccgcctgagtaccagacacaacgatacctcctattcgggcagaaatcatgaagccaaagctcaagttcttatatctgaaatcattcctccatcccattgttgcatcaggtaaaagacttcctaacttcaaatattcgtttctcggcttcaagtcttgagagatatcaatattgccataagcatctcttacaaaatcggtttttgcatagatgtctcccaatgtacctccaggacgcaagataatctgagcatttccaaaattatctttcagaagttcatccttttcaaacaagggttcattcggattctgtgggtttttcacattcgctacaagttccttaatttcattcttgttataaccataggtaaagttagtatcccaggaaaaattctttccaatgtttattgttcctcccaaagcaatttcgaccccttgattttgtacattaccggtctgtacataagtatagttataaccggacgaagccgacatagcggccttaatagtctgattcttggtatttgtcttataataagttatatcaaagttcaatttattttgtatccacttggtagtcaatccgatttcaaaggagttagtacgttccggcttcaaatccttcaacggatagtaaccttccttcacccatttcttatcatcctggctaaaagtattaagttgcatagtcaaccctctttggaacggcgaagctacctgtgcataagcaactctcaacttggcaaaagacagtgaattatacattttatttctcagttcctctgaaagcatatcagtcaagattcctgaaagacctatagaaggatagaaaaacgacttatgatttgaaccagacaactgtgaggcccaatcattacgcccggtaaccgtaagaaacaacaatcttctccagctgacttccaaacttccaaatacagactgcgtctgttctctccatcctttttgataaaactgagctttctgagctccctgttcaatattctgcacattgaatacattaggcaagccatcatttctcaatggcccctgatttatcaatgcatcattcatctggtcggtcaaactggctcccacattcaaagccaaagtataatcatcagcaatatttttattcaggttagtgagtacatcaacatagttttgcatatcccaactattttcaagaccaaagaagccattcttggtacccccgttcagcaaagtaggaattgttcccacaaaacgcttatccttatattcctgacttgtgcggtcaattctgtatcgagctgctacatcccacttttcagaagaagaccactctttaataacgtacgaaagtcccagtgatacaatgaagcgctttctttcagaagtacggatgtttctataagccacccagtacggattctgcatcgtataatctccttgcgggaaaggacttgccgtaagcaatcctcgttcgtcatcccacatttcaaaatattgtgcattgttccaatcaaggcctctaggatacagataagccccgaccaccggattcatgtattctccctgattcaccatattctggtcacgctgtacaatatattgtgctccgatatccattctcaactttcctttaagagcagtacttgaattacgcaaggtaatgttgtagcggtcgtacacattattgggtatcaacccattggcatttgtggcagccaatgatgcataggtttgactcttttcactacccattgaaagagtaacggcattggtataagtagctgaagtcttgaagaaatccgttggagaataacctgtagaaggttgtttctctccccagcttacagccgcattcggcaaactgccataggtattctgaaattcaggcatgataaaaggatgagcaaactccatggaagaagagaatgtagcttccaacttaccttcctttcctttttttgtagtaatcaaaatagctccattggcggctgaagaaccgtacagagcggccgccgaggctcctgtaagtactgtcatagactcaatatcttccggattaagatcggcaataccttccgtagatcctctggaagcataacgtcctgaaccttcgtcccctaccgaattgaacataggtacaccatcaattacatacaaggcattattacttccttctatcgattttactcctcgcatcacaacttttgtagctccaccgactccggaagaactactctgtatgttgacaccggcaatctttccattcaagctatttataagattcgcatccttcactcttgtcagctcatcttgctttacattctgtacattatacgatagagctttttcttgtcgcttgatacctaacgcagttactactacatcgtccaatacttgtgtatcttcctgaagcgtcacattaatttcagatacccctgctgaaactgtcttttttatgctagtataaccaataaaagaaaactccaatactgcgccgtccgacacttttatggtataataaccatccaaatctgtcacggtaccgttcgtcgtaccaaactctatcacatttaccattatcaacggcagacctgcattatcaagtacctgcccttttatttctctgatttgagcattgattatcccgcataatcccattatgcagaataaaaatataataagtctgttattcatcgcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaaaaccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtcatcgatgttcagtattaaattaataaggtatattttccagattatccttggtcagcgtaaccttgaatccactagtgatattagctcccgattcacgtttgatggaaagcatcggaatataattccataagacaggacttatgaatatagccacttctttatcggaactaatctccacattctttattaatatagtaactggtaagtcatttgcattgatgacattctgttcagacttataaagaccttcaaagctcaaccctgaatttatggctgccgttagcttttctgaatcattaagcacatatacaaaggctccttcccagctaaaattgcatccttcaaaattattcacagtaacttcaaggtcgacaacctttttaagtactccaccactagtaggaggtacatacggaaaattgaattccagatcatagttacttgtctccgaattgacagttacttccatcttttgaaagctatcatagtaatctgtattccatttaggaatatatactatataatcttttgctccttccgtacagaagacttcaaagacggcagttccgcccattatggattttttctccacatacgtgccagcttcagggtgtccgtgctgattcttgacaacctcctccactgaaggccatttacttgcttctatcagataaatttcatggttgtccaaaggagtatcccccctaacagcagatacactaatcttttttttctgttctttctgaaactcacactctacttctgtaacattataatcgatttcacgcaaatcatgtttaagataggctattccttcctctggatttactaaaaacaagacatagcttttagcagacaaaggagtatcaatcatcaatttcgtactcatctgctgagtggtagctttctgcacatataatccctcttcaatcactccacccgttaacatggaactaagaaaagctgtttggttttctttctgtacaagaaacaagtctttattcaaataatcggaaggcacagtcacttctatggtagtctgtttgatagactctgaagcctgtgctccacaatctattgttttttcaatcttgccaaaagctacaaagtacttcaactcattcgttttgttagtgagcggaataaatgaatccccctctactttaaatacattgacataaacatttgacttataatatgctgtcaaatcatcaaatataaccttagcagacttaatcggttgctgaaccaaaaaatcagacttggaaatagtagagataccaccgtactcatcaaaaagactcttatcaagtattccgatcaccattccctcagatatctgcaaattctttaaggtaagtgttaaaacagatttttccctttccacagattgtttctcagggacaaagacgccatttaccacatcattcgaacaagagggtaaaagccaaagcacaatcattgcacacaacaatgtaaaatgattcctcataaagaaaaaatttaagattaacaataaaaacaaaataatgaacgattgatatataatcaatagatcatcacccaacaattaatagtttagtttaataattccaatttaatagtttagttaatagtttattaatagtttagtttaataacttagttacatagtctagttcaaataatacataaatatctactttctaagaaaataaatacccccaaaaataaatacaaaaatatatgagaacacaagattctctaaacaaaaccttaatgatattggccttcatcttatataaacgattgcaaagatatgcacaaaatattcaattacaaaaaaagtgatataaacctatcttgaaacaacatatattaacaaataagatttttctgtttatatatgtgaacaaaacaagagtctgccccttcaatgactctaattaagcaacaatctttcccttcgtaattttatcacaattatgacattttcatttacagaaagacaacattgtctgaaatttcagacaaaaatatcactaaacaagaaaataaaaaaataaaaagtttatagatcaatgtacaatcactacagtaaaatatcttatccgaaaatatcacccacacccttaactaacttcgactctaatagtaaaattccacctcttataagtgagaaacgaatcataaaacaagtaataacttggctacaaacagacatttgagcagcaataagacaccaattaaagttttacaacagaaggaacaaactctaccgcccaattcaaaaacagaatatattcagaaataagttctttgataccttgtggttacctataaatccaatgataaaagtcacccattttcagatgttagctgagaataaccaataaaaaaagtcccgtaaacatattgttcacgggacttaccttaattaaccagcggagagacagggattcgaaccccgggtacctcgcagtacaacggttttcaagaccgccgcaatcgaccactctgccacctctccaaaactcctttataagagtacttccttccgaaagcgctgcaaaggtacgcattatttccaaacctgcaaattatttgccccttttttgattattttttcctattatcgtaactttgtaccttgataacttatattaatatagacttatatccagacaatgatatatccgcagaactttgaacagaaaataggattcgaccaaattcgtcaactcttgaaaataaaatgtctcagcacgctgggagaagaaagagtagatcaaatggacttttccgacgattataacgaaatcaatcgacgactggaacaagtaacggaatttgtccgcatcacgcaggaagaagatgattttcccaatcagtattttttcgatgtccgcccgtcactcaaacgcatacgtgtggaaggcatgtatatggacgaacaggaattgttcgacctgcgccgttcgcttgaaacgatacgcgacattgtacgctttctacaacaaacagacgatgaggaagatactgacaacgatgaaacccactccccctacccagctctgcacgagcttgccggagatatcatggtatttcctcaactcatcacacgcatcaataatattctcgataaattcggaaaagtaaaagacaatgcttcttccgaacttttgcgcatccgacgggaactggcgtcaactacgggaagcatatcccgaagcttgaataatattctgcgggcggctcaatcggaaggttatgtcgataaagatgtagctccaaccatgcgcgacggacgactcgtgatacctgtagcccccggcatgaagagaaagatacgaggtatcgtacacgatgaatcggctaccggaaagactgtattcatagaaccagccgaagtcgtagaagcgaacaaccgtatccgtgaactggaaggtgaagagcgtcgtgaaatcattcggatacttaccgaattttcggctacggtacgtccacaggttccggccatcctacaatcttacgagttccttgccgaaatagactttatccgagccaaagcactgttgggtatcgacttcaaggcaatcaagccttcattcgagaaccgacaggttattgactggttcgaagcggtgcacccgctgcttcaaatgtccctggctaaacacaataaaaaggtagtaccactcgatatagaactgaataccggacaacggatcttgttgatttccggacctaatgccggtggaaagtctgtttgtctgaaaaccgtcggactattacagtatatgcttcagtgtggtatgctggtgtctatgcacgaacgcagtcacgccggaatcttcagcagcatcttcatcgatataggcgatgaacaaagtatagaagacgacttgagtacatattcttcacacctgacaaatatgaagaatatgatgaagtactgcaatgagaaaagcctgatactgatcgatgagttcggaggaggtacagaaccgcaaatcggtggagccattgcagaagccgtactgaaacgcttcaatgcaaaaaagacttttggagtgattactactcattatcagaatctgaaacactttgccgaagatcatgaaggagtagtaaacggtgccatgttgtacgaccgccatgaaatgcgtgcacttttccagttgcagattggtaatccgggaagttcattcgccgtagagattgcacgcaaaatcggacttccggaagaagtcattgccgatgcttcagaaatcgtgggaagtgaatacatacagagcgacaagtacctgcaagatatcgtacgcgacaagcgctattggaaaaccaaacgccagaatatccgcaagcgggaaaaaataatggaagaaaccatcgcccgttatgaaaaagagctggaagaactggataagagccggaaggaaatcttgaataaggcacgagaagatgcagaacaattgctgcaagaatcgaatgccaagatcgaaaataccatccgtaccatcaaggaagcacaggcagagaaagaacgtacccgcaccgcacgtcaggaactgaccgacttccgccagcaaatagaagatgagaacaaagcggcgatggaagaaaagatcgcacgcaagatggagaaattacgcgaaaagcaagagcgcaagaaagataaaaagagcaaacaagcgagccagccggcagtccagcctgtacctaaagtcattcctctccaagcaggcgactatgtacgaatcaaaggacagaccagcgtgggacagatcatagagatcaacgggaaaaatgccgtagttatgttcggactgatgaaaaccaatgtgaaagcagatcgactggaacgcaccgatgctcccaagcagactctcaatacggcgaaggcaacttttgtcagcagtgaaacgcaggatcgcatgtacgaaaagaagctgaacttcaaacaagatatcgatgtgcgaggcatgagaggtgacgaagccattcaagccgtaacttatttcattgatgatgccatacttgtcggagtaagccgtgtacgtatcctgcatggaaccggaacaggtattcttcgcacacttatacgccaatatctcgctaccgtgccgggagtagcacacttccaggatgaacatgtacaatttggaggagcaggcataacggtagtcgatttaaaataaaaaaagtatctttgtataaagtatctttgtattatgaaatcaattaaagaattataccgcattggtacgggtccctccagcagtcatacgatgggaccgagaaaagcagccgaacagttccttgcccgccatccggaggcatcgtcttttcaagttacactttacggaagccttgccgctaccggtaaaggacacatgactgatgtcgctattctggacgtacttcaacctcatgctcccgtagagatattgtggaaacctcatgtattctttcctttccaccccaacggaatgacattcaaatcgttcgacaagaataataaaaagaccgaagagtggactgtcttcagcgtaggcggtggtgcccttgccgaagaaggacaagacaagaatgcaactcctgaagtatatgatatgaataccatgaaccagatactttactggtgcgagcataccggacgaagctactgggaatatgtagaacagtgtgaaggtcccgatatatggaaatatcttgccgaagtgtgggaaaccatgaaagaagccattcatcgcggactggatgcagagggagtactgcccggtcctttgaacctgcgacgaaaagcatcttcttattatatccgtgccaagggatttaaggattccctgcgttcacgcggactggtttttgcttatgctcttgccgtaagcgaagaaaacgcatcaggtggaaaaatcgtaactgcaccaacctgtggggcttgcggagtagtgccggctgtattgtaccatttgcagaagagccgggaattcagtgatgcacgtatcctcagagcactggcaactgccggtcttgtgggcaacatcgtcaagcacaatgcttccatctcaggagccgaggcaggttgccaggcagaagtgggagtagcttgctccatggcctcggccgctgccagtcaactatttggaggcagtccggcacaaatagaatatgccgccgaaatgggtctggaacatcacttgggaatgacatgcgaccctgtatgcggactggtacaaataccttgtatcgaacgtaatgcgtatgccgcagcccgtgctcttgatgccaatatttactcagcctttaccgacggacatcatcgtgtatcgttcgataaggtcgtagaagtaatgaaacaaaccgggcacgacctgccttctctttataaagaaaccagtgaaggtggcttggccaagaactatcaacccatggactaaaagcctatttttcaattttgccagagcctcttctggaatgcacaatcgtaaccattccaaagacagccctggcaaaattatgtcattgaaacgcttattcgaaagactctcagtctgataaccctatattaaaatgaaatcatacaacgtttatctattcgacttcgactatactcttgccgactcttcccggggaattgtcatgtgctaccgcaatgtgctggaacgccatcaccatacaggaattaccgatgaaaccattaaacggacaattggcaaaaccttacaggaatctttctccatcatgactggcataactgatgccgacacattggaaatgtaccggaaagaatacgttaaagaagcagatacccacatgacagccaacacgttcctctttccagaaacgatagaggtactcacacgtctgaaaacaaatggagccaaattgggcattatttccacgaaataccgctaccgtatcatggaactattgggaaagaaactgcccgaaaactttctggacatcatcgtcggcggcgaagacgtacaacatcccaaacccgcaccagaaggagtcctgtttgccatcggacacttaggctgccggaaagaagatgtgttgtatgtaggcgacagcaccgtagatgccgaaaccgcacaagctgctcaggttgactttgccggagtactgcatggagccactacatacgatgaacttgcggcctatccacatgtagcaatcatgaaaacccttgccgaactctaaaaaaatatacatattttctctctaaacagttggttatatgaacaaaaagcagtacctttgcgtccgattttagtccgtggaggtagaaaagtaaccggatgagaacggttcaccttgcggaagaaacccgtttaatatatatttaaaatgtacgtaattgtagaaattaacggtcagcagttcaaagctgaagaaggcaaaaagctgttcgttcatcacatgcagaatgctgaaaacggtgcaactgttgaatttgacaaagttttgttggtagacaacaacggtactgttactgtaggtgctcctactgtagaaggtgcaaaagtggtatgcgaagtagtttctcacttggtaaaaggtgacaaagtattggtattccacaaaaagagaagaaaaggttacagaaaactgaacggtcaccgtcagcagtttactgaattgactatcaaacaagttattgcttaatcattaaaaacgtagaaagaaatggcacataagaaaggtgtaggtagttctaagaacggccgtgagtcagctagtaagagattaggcgtaaagatattcggtggttcagcttgcaaggctggtaacatcattgttcgtcaaagaggaacagttcacaacccgggtgaaaacgttggtatgggtagtgatcacactctttacgcattggtagacggtacagtatgtttcaagaaaggtcgcgaagacaagagcttcgtatctgttattcctgctgaagcataactttataccacaaaaagaaattgaaagaaggtatcctcgcaagaagataccttcttttttattgccttcttttcaagaaaggcgaaaacaaaagaatcgggcgaaaccactttcttcaagtaggcttcgcccgatttataaaaacaaataatcttactattattcagcagccttttcctcagcaacttcttcagcggcaggagcttcttctacaaaatcactttctccgcttgagataagcaaattgtaccactgaatcaattttttgatatcactggtatgtacacggtcgcggtcatattccggcaacacttcagccatgaaagcgtgcaattcttctacagatgctttcttataatccaaagaagccaccttaccaccttcttttttctttacagaatcaagaaccgtagccaaaggtacttcatcatcatttgtgtacatggcgatatcacccagtgaaatcaccttatcgctggcatagataggcattcttttcttattatcgacagcttctacaatcagcatatttttagcctgagaaatcagtttatacaatcccggtttgcctgagatagctaaaatagttttcaacatacgattttattatttttagttattatattaaacaaaaatacaactcataggtgacatacacaaacatcttgcccaccttttctattttttaaggctttcagcaatgcatccaactgaggagataacgctctaccgtcgtttacgattacaaaatcggcatggtcacgcttcagttcctcattcatctgcgaagaaatccggcttttgacctgctcttccgtagcacaatcgcgctccattgcccgccgtatccgaacctccagaggtgcatacacggcaactacataatcgactacatcatcgaatcccgactcatataaaatagcactttccaaggctacaacttcgtgctctgcacgagatgctgcccaacgaaggaaatctcgcttcacacacggatgcactatagagttgatacgggaagcatgctcgtcgctcgcaaacagataatctgccagcagcggtttgttaagtttctcatcaacatagactctttctcccaacaagccaatcaagcctgcccggatatccgcatcggaaagcatcagacgcttggcctccgtatctgtatcatatacaggcaagcccctttgtgccagcaaccgtgccacatacgactttccgcttccgattcctccagtaattcccagtctgatcataaccctcaatcttcttctatagtctgctgttcaatcaagaaatcgacagaggaaggattcaccctcacatgacttacaaaatcgggagccccttttacaaccaaaggtaacttatcacctttcgacttcaagacatcttcataagttactccgataaaaaaatcatccgatgaaacatccttaaagtgtctcaaccccacctgaaaagtcacctgaaccttggaagggaatgtacgaagcacttttcctgccgggaaattaatacctacaaccggaacatccacagtcttttccgaatacatatcaacatataccgacagatcattgtatgcaggaatgaacttcactcctttcagcttgcccatactcacccgctttttcagcgtatcggaaacgttttcccaatacagtttttccgtataagcagccttcaaggtatccagtatttcctgcggagcataagccataacagaatccggactaaaacttatccgcgaaatataatactggcgggcagcctgaacagttccaacaagtcgtacaggaaccttcttagcctttgcctgcgtataaataaagtcgagtgtatcgggacggatagacaatactttcgtcgaaacattcaattgtgccgcaaccttcttggttaattcggcagacgatatgcacacatgcgttccctcatccttataatcattgaaatcgaaagagatagggaaaaacgtcctgcccagcatataattcagcaaaacagtacccctatcttccacccgtatacgcacatcgtccggaaaatcggaggtaagcacaacttccttcgggacattcttcaagcgtaccggcaccttgaattccgtctgataagactcatccaacgtctgcaacatccagaagcagaatgaaatcagcacaaaaaacaagaagatcagacattccctgaacttatcgctaagcaggaatgttctgatcttccgtaatcccagtctataatatctctttatgttctttacatcgaacatagtgacttatacttttattctttatttagtctgagtagcctgagcatctgcatagatagaattcttgtctaccttgatttttactccagatgcaatttccacgataacggcattatcttctatttcctttatctttccatagataccaccggcagtaataaccgactgacctacttccagattcttacggaagtttgctatttccttctgtttcttgttctgaggacgaatcataaagaaatacataatggcaaagatagccaccatcataatcaggaaagagtaatcacctcctccggcctgctgcaaaaatacagttaacaaattcataaattcttcttagtttgattaatattagacgaacaaatatattaatttttcgtcaacttattttcctttttcaattgattaactattccgtccaaggttccgttgataaatccaccacttttcggtgtactatacaacttggcaatttccacgtattcgttcagcgatacgtttatcggaatattcgggaaactcaggatttcggcgagcgcaatctgcatgatgatgacatccatgacagccacacggtccagatcccagttttttgagttctcactgatcagatgacgatagtaatcggcattcaggatagaacgacggaacaagcggcgtgcgaaatcctgatcttcttcatccttgaattccggaagcaactcctgtttgtcaccattcttaggatcgaaacgcttgatggttttcaagacaaaagtatccacgatttccttaccatcgttccagtacaagctctggtcttccagaacctcatcaagagccgtattattgaatatgatgcgcttgtaaatctttctccacagttcacgatcgtcttcgtaggatgaagtttcgcttgccatatactccttatatatatcactctgcataatctgctcgcacagattcttgatgaagtcaccttcgttctcccatgttttcttctgggtgctggcaaattcattcaactgcttgtttacctccagctgagcgataaaacgattgtccacgaattttgtgtttggattcaaatcctccttggtaggagccagtttgtgtttagccgcatccaaccgcttgttggcatagcgtgtaacctctaccatgagaagcaggagatagttatacaaatcgtacgctttggataaactgaagaacaactccttttccgcagtatccaaattttttccaccgttctgataataagcgtagataatctgaactatcttaagacgaataagaactctgttaatcatactatatttttaatataatttcgagttgcaaaaatagttattttccaacatacaaaacaaatctaaggcgtttttttatacaaaaatattattcacacagatttttgagagcagttctttgtatttttcaaaaaaatcatcaaatttgaagcggtttttaatacattacttatggaagatttgaaaaggaatacagcaacagacgtagacaaggaaattgtgttttccaaggccataaaggcaggaaaacgtatttactatctggacgtaaagaaaaacagaaagggagaaatgtttcttgccattacagagagcaagaaggtagtttccggtgaaggaggaaatgcgccacaggtcagcttcgaaaagcataagatattcctatataaggaggacttcgaaaagttcatgaccggacttcaggaaaccatacagtacatcgaaagcgaacagggaccggcaaacatcgaacactcagcagaagaagacggttctcattttgccgacaacactgattctccgctaaaaccggatgaaataaaaatagacattgatttttaaattccgcacacacaagtgtacggtataaagctatatcaaaatagaacattccagcagttctatcctgatatagctttttttaatgcaattatgcctttcggtggcacactgtaccgtttgcctggaaggtaggcatgacaagcacttcggctatctgtacatgtgccggagccgaagctgcataataaactacttcggctatatcatcgcccgttaacggacggattcctttatataccgcatcggccttttccttatctcctctgaaacgaacgacagaaaagttcgtttccaccagtcccggtttgatatttgtcacacgcaaaggagtatctaccaagtcaatacgcagtccgtcggacaaagccttgacagccgctttggtagcgcaatacacgcttcctcccgcgtaggcagcatcgcctgctaccgaacctatattaataatgtgtccacactgacgttctaccatgcccggaaccaccatgcgcatcatggcaagcagaccttttatattggtgtcaatcaccacatcccattcgtcaagcgagccttcctgctccttgtcgagcccgatcaccagtccggcattgtttatcagtacgtcgatgtttctccactttccttgaagtgaatcgagtgcctgcttcatcgcctcacggtcgcgcacatcgaagggcaaggtcagcacttcacatccctgtgccgtaagttcctgtttcagcttttccagcttttccacgttacggccgttcaatatcaggttactgcccattgagccgaacttgcgagcacacccctctccaatgccactggtggcacctgtaatcagtattgtctttcctttcatgattgataacatataaaaaattccatcgcctgcaaagttataaaagttatcggtgcgatggcataaaacaactcatttccccaaacagaccgacagataaatttccggctttccgcatgtcttccagaaaacgtcgggacgtttttttattttttgtacaaaacattttttcttttgtacaaattttcctgatatatcagcagacattcccccagtcctgcccatcttctctccccaagttccgcccttattccattcaaaataacaaaaaaagcgcaacaacattttgtgaactcaaagataatcactacctttgcaccgctttttttaagctcatcgtgtgatataccacatcgtgtgatggcgaattaagcaacaaaaacaacttaatttagagtaacacaaaaatttttcaaaaaatgaaatcaattgaaattaaaggttctttgagaactgaaacaggtaagaaagctactcatagcttgcgtcagaacaatggtgttccttgcgtattgtacggaatgcagaaagacgaaaacggaaacccggttgcaactcacttcactgtaactgttgacggtttgcgtaagttggtatacacaccgcatatctacgtagtagacttgaacatcgacggtaagatagtaaacgctatcatgaaagatatccagttccaccctgtaacagacgctatcctgcacgttgacttcctgcagatcaacgaagaaaacccgatcgtaatggaagttcctgtacagttggaaggtttggcagaaggtgtgaaagccggtggtaaattggctcttcagatccgtaagctgaaagtgaaagctctttacaacgtaattcctgaacgtctggttgtaaatgtaactaacttgggtctgggtaaaactatcaaagttggcgacctgaactttgaaggtctgactttgctgaacgcaaaagaagctgttgtttgtgctgttaaattgactcgtgccgctcgtggtgctcaggctgctgctggtaaataatcttatttaacaacctgacaacaacaaaaatccctttcaatgaaatacttgattgtagggctgggaaacattggtgccgaataccatgaaacccgccacaacataggatttatggtattggacgcccttgctaaggcgtccaatattgttttcaaggacggacgatacggagctacagccacactttcgctcaaaggtcagcaactgatcctgctgaaaccatctacttacatgaatctgagcggcaacgccgtacggtactggatgcagcaggaaaagattccgttggaaaacgtgctgatagtagtcgacgatctggctcttccattcggaagcctgcgtctgaaaggcaaaggtagtgatgccggacacaacggtctgaaacatatcgctgccacactgggtacccagaattatgcccgtctgcgcttcggcatcgggaatgattttcccaaaggagggcagattgactatgtgctgggaaaattcagtgatgaagactggcaacagatgcccgaacgactggaaacggctggcgaaatcatcaagagcttctgtcttgccggactgagcaataccatgaatcagtttaacaacaaataaaacaaacaacacatggctgaagcaagaattgacaaatggatgtgggctgcccgcatattcaagactcgcaccattgctgccgaggcttgcaagaaaggcagaatatgtatcaatggcgcacaggctaagcctgcacgtatgataaagccaggcgacgtaattcaggtgaagaaaccacctatcacttactcgttcaaggtactgcaagccatagaaaagcgtgtaggagccaagctggttcctgaaataatggaaaacgtcacgactcccgaccagtatgaattgctggagatgagcaaaatcagcggtttcgtaaaccgtgccaaaggaacgggacgtccgacgaagaaagaccggcgagacctggatgaattcttcactccggaatatctcgacgactttgacttcgatttcgacgacaacgacgaagaagaagaataaaaaaccgggtatgaattgcaggaaacattccgtaatccatacccggttcttgtttatatctacgattacaagtttgctttgatggcatcaatcagctcctgatattcagcatcactcagatagaccttgcccggattcatctggaaagttcctccatagtcgggaccatctacatacttcggagccagatgaaagtgcaaatgcgaaagcttatcactatatgctccgtaatttatcttctccggatggaacgctttgtccatcgcacgagttacacgtaccacatcggccataaacgcattacgctcttcatcactcagttcattcaggtcgttcacatgatctttgtaagctaccagacaacgtcctctataagtttgttccttaaacagaaagacacgcgaaacactcagctgaactatttcaatcatcaggttgtgcaaggtttcattgttctggcaatacagacattctttcggatcactcttcataattgtgttcattaaaatattaatactatagttttgtctaataactgtatgtaaacagtttgttcaaatcattttcttcgcctacaacccataccacatcgttttctttaaacggagcatgtacctgaggggtacgcaagacatcttcgccggctgattccacaccgactaccagacaatggtatttgtcgcgtatgccacattctgcaatgctgtatccgataaacggtgaatttttcccgaccacgaactgtttcagtttcatctcgtgcttttcaaagtcttcatcgtcgtaagtatgcgtagctttttccgccacttccgcaaaggccgataactgctcatcggtaccgataacctgaagcgtatcattcgggaatatgcaggtatcgccagtcggtatgttcacccggtgctttccccggatgatagaggctacatgtacatcgtatttcttgcctagatcgagttctttcaggctcttacctgcccacgatgattcttccggaacctgaaaatcactcaggtgaagatcacgatcgagcagacgtcctgcgtactcgggttgtttttctcccaaatattcctgctgaatttccttcgaacgtaaattgtggacgaaggtacgttccagcacaatagactgttttttgaggaaacgcgaaaagatcatgccgcataccagaagaatggcaattcctaccatcagcgctgccgaagcccggaacaggttttcgatgatgaaaacaacaaaaccaatcgcaatgacgatacgcagcagaatcaatgaaatcagcggtgcatggttaaagcggctgtccgaccacaaagacttgaactcgaccgaacggtttttcttcatgatcagtgcacgcaggaaaggagcaatagccgctatggtcaggactcctcccagtatctttccccacaaatcgcccagcatgcccgtaatcagaggcacaatgaaatgcaggaacaaggcagtcactgcaaccgaaagtacagaataaatcaagacgatacgaataatggcagtcaccagtttcttccagttgttgctatgattcactaccgacgcacccgaagaatagcgttccagcaagcggcgccagcgaaccggtatatacttgtctatcacctgataggccggtacggcaagacgaatcatataaggagtcaggaaagtggtgataaccgaaacagctactacgatgggatacaggaaatgactggttaccttcaggctgacacccagtgaagcgatgatgaaggcaaactcacctatctgcgtcaagctgaagccacactgcatggctgtcttgagtggctgtccggaaagcaggacacctgccgtaccgaaaatggtctgccccaaaataacggctaccacaataaccagaatctgcactttatattctacaatcatcgaggggtctaccatcatacctacggaaacgaagaagatggctccaaacaaatcctttacaggagccaccagtttttcgatgtgttccgactcgacggtttccgacaagatagaacccatgatgaatgctccgaaggctggagagaatcctaccagcgatgcgatatataccattccgaagcacaatgccagcgaaacgatgagcagcgtttcgtcgctcatcagcttacgtactcgcttcaagagaagaggaataccataaatacctaccacaaaccagagtatcaggaagaataccagcttcagtatgctgtataccatttctccgccctcgaaattcttgctaaccgccatggtagaaagcatcaccatcagcacaatggccagaatatcttccagaatcaggatgctcagtaccagtcccgcaaagcgttgctgacggagtcccatatcatcgaaagccttatagataatggtcgtagacgacatggcaagcataccacccaggtaaatgcagtccatctgtccccagccgaacgtccatcccacaaagataccgactagtatcatacagaaaataatggtacatgccgaaataatggcaggtcctccgatcttcatcaacttcttcaggctgaactccagtccaagagcaaacaagaggaagattacacctatctccgaccagatatgaatactggcagaatcgactaccgaaggagtaaacttaaaatgcggggtgcagataaagccagcaacaatataccccagtaccaacggttgcttcagcttcttaaagataagtgtcatgataccggcacatatcagaatcagtgccaggtcacttattaatggagttaattgggacatttgtaattacatattataattgttgccgcaaaaataagtaataattttaaagttgcgtcgcccaaagacaagttatttcctttcagacaacaaaacctgccaaaaagatttttccaagaatgtgaagggtgtgaagcgtataaatagcgaattgaatctatagacaactgctatatgcatatttttgactaactttgcccgacaataaccataaaattatcaggaagaaaacatgatagtctgcatagccgaaaagcccagtgtggcacgcgacatagccgaagtattaggcgcacgaaaccggaaagaaggatatatcgaagggaacggataccaagtaacctggaccttcgggcatctctgtaccttgaaggagccgcatgaatatactccggcatggaagtcatggagcctgagcagcctgccgatgcttcctccccgcttcggcatcaagctgataaacgatccgggtatcgaaaagcagtttcacatcatagagggactgatgcagcaggccgatgaaatcatcaactgcggtgatgcgggccaggaaggagagctgattcagcggtgggtaatgcagaaagccggggcacgctgtccggtcaagcgtttgtggatttcatcgctgaccgaagaggctatccgcgaagggttcgccaacctgaaagagcagtcggagtttcagccgctgtacgaggcgggactgagccgtgccataggcgactggttactgggaatgaacgctacccgtttgtacacattgaagtacggacagaaccgtcaggtgctttccatcggaagagtgcagactcctacgcttgccttgatcgtaaagcgtcagcaggaaatagagaacttcaagcccgaaccatactgggaactgaaaacagtatatcgggaaacaaccttcaactcaaccaagggtaaattctcgtcgaaggaagaaggtgagaaattcctagaaaccgtccgcaattccgacttcaccgttaccgatgtttcggccaagaaaggaacggaagctcctccccgactgttcgacctgacatcgttgcaggtggaatgtaacaagaagttcagctactcggccgacatgaccttgcagcttatccagtcgctttacgaaaagaaagtggctacctacccgcgtgtagatactaccttcctgagtgatgatatttatcccaaatgtccgaacatccttgccggactgaaagattatgcgggtttcacagctccgctggccggaaagaagttactgaaatcgaaaaaggtattcgacaactcgaaggtgaccgaccaccatgccattatcccgaccggtgtgcagccgcagggactgaccgatatggagaagcgggtattcgacttgatagcacgccgttttatcgcagtcttttatccagactgcaaattctccacaactacggtattgggagaggtagacaaagtggaattcaaggcaaccggcaagcagattctggagccgggctggagagtaatctttgccaaagaacagcaggaagagcctaaggaaggcgaagaagaacgtgttctgccgctcttcaccgtaggcgaaagcggaccgcatatacccgatctgaccgagaaatggacacagcctcccaagccttacaccgaagcgactttgcttcgtgccatggaaacagccggaaaactggtggacaacgacgaactgcgtgatgcattgaaagaaaacggtatcggtcgcccgtctacccgtgcagccattatcgaaacacttttcaagcgtcactatatccgcaaggaaagaaagaatctgattgctaccccgacgggagtggaactgatacagcttattcacgaagaattgctgaaatcggcagagctgaccggtatctgggaaaagaaactgcgcgagatagaacgacgcagttacgatgcagctacatttcttgccgaactgaaacagatggtaaccgaaattgtatacactgtgctccgcgacaatacaaaccggcgggtaaccatcatgcccgatgaatcgtcggacaaaggaactacgaaatcaaaggctaaaaagggaagtacttcaaagactaaggcttcggacaccgaaaatgagacagcctcagccaagcccaaacgtacccggaaagcaagtaccacaaccaaagagcaaacagctgctgcccaaacgcagccggtaccgacaaccacgcaggcggcaacaggagatgaactgattggtaccccttgcccgctttgtggcaaagggcatattattaaaggaaagacagcctacggatgctcggaatggaaaaacggttgcacgttcagaaaaccattttaaggttttcgggcaggtaaccgctgcgtatacgccactcctgtggataaaggttattggcacggttgccgatgttctttacaaaacctaacggaacatcttggtaagccaccagcacatatccacgggggacatcggcatccagtacaaccgcctcctttctcaaataagcaatggcctgctcatacgtcaggttggttacaggaaaacagtctgtactgcgctttaccgacatggctaaggcgtggtcgggaatgcaatccttgcctttcagtccggctaccgtaatgccggcatgaagtactttcaaggtagatttcacagcttcatatacttcctgatgaactacggggaaagctatcacctcattgttctctaccgtccagacatactgctccggactgtttacccaagtcttgacttccttcggacagattaccgtctgtcctccggctttctgaccttttttcttcttatcctttttcggacgcttacccgcgctgtctgcggaaactcccatcgtaccatcttcatgcttacgaagcactgccaggaacaacccctcccctacagtacgatgtggcaggaaacgatataccggaaactcctctccggtcagatttcctgtaatgttccatgcttcttgtacggctaccggaagcacctcagcccccagttcgcgggcaatccatgcaacattatcctcgttttcttctcgattgtacgtacacgtactatagatcaaaatacctcccggtttcaggcaaggccagatatccttcagaattcggcgctgccgctgccagcagacagtcacattgtctacactccattcgtcgatggctaccggatccttgcggaacatgccttctccggaacaaggtacatcggtgagaatcacatcgaacatggcttccagcggagtaaaatcggcaggatcgttattcgtgacgatcactccctcgtcgccccatttgatcaggttctcagccaacacctgcgaacgatttctcatcacctcgttggcaaccagcagactgccttcgggcaataccgaacgaaccagcgtagacttccctcccggagccgcacaaaggtcgagcatcacgaccggctcatgcacatactgacgcacagcctgctccacaaacatggaagacgcttcctgcacataataactcccggcatgaaacaagggatcgaaagtaaacgtaggacgagtattcagataatatcccgtttcgcaccaggggactggagtactttcggtgggcacggactgacatttagtccggttcagacgaatacttacgggcgtatcgtgctgcaaagcctcgtataatttttcaaactgtgcttcccccagcaaagtgcgggtacgtgtgataaagtcggaaggaaggttcatacaataaaatgttcgataggttttcggggtacaaaaatagtacaaatagcatttccccccaagatattttctatacctttgcaaacaaaaaaagagattcatcctcatgaaacaatatttagacttactgcaacgcatccgcacagagggagtcagaaaagacgaccgcaccggaaccggtacgatcagcgtattcggacatcagatgcgttttaatctggaagaaggttttccgctggttaccaccaaaaagctccacctgaaatcaatcatttacgaactgctctggttcctgaaaggtgataccaatgtcaagtatctgcaagaaaacggagtgcgtatctggaatgaatgggcggacgagaacggtgacttaggacatatatacggctatcagtggcgctcatggcccgattatgaaggaggctttatcgaccagatttcggaagctgtggaaaccatcaagcataaccccgattcaagaagaatcatcgtcaacgcatggaacgttgccgacctgaagaacatgaacctcccgccttgccacatgttcttccagttctacgtagccaacggacgtctgagcctgcaaatgtaccagcgtagtgcggataccttcctcggagtaccgttcaatattgcttcgtatgccttattgttgcagatgatggcgcaggttactggactgaaggctggagattttgtacacaccataggcgacgcgcacatctatctgaaccatttggaacaggtggacttgcagcttacgcgtactccccgtccgcttccgcaaatgaagctgaacccggatgtgaaaaacatcttcgacttcaaatacgaggatttcgaactggaaaattatgatccgtggcctcacattgccggaaaagtatctgtttaacccctataatgaaacataagaatatgctgtcgattatcgtagccatcaacaaaaacagaggaatcggattcgagaataaacttttatactggttgccgaacgacttgaaacgtttcaaggcgctgaccacaggacataccatcatcatgggaagaaaaaccttcgaatcgcttcccaaaggtgccctgcccaaccgccgcaacatcgtgttgagccgtacctgccacgagtttcccggagcggaatgtttccattcgctgcaagatgccttgaaccaatgtaaggaggaagaagaaatctatattataggaggagcaagtctttatgctgaagcattgcctcttgccgaccgactgaacataaccgaaatagaggatgcggataaggaagccgatgttttctttccgcccatcaacctcaacgaatggaaggaagtacaacgcgaaagccattccaccgacgaaaagcaccaatatgcttatcattttgtagactacgaacgtatctaaaacaataaatccccgcttccggcggggattatcatttttatctcttcttcttgaaaaaatctttcatcaactttgcacagtcctcggcaagtacgccttttactacaactgtcttggggtgcaaggcatcgggcgcataccgctgatagcctcttttctcatcttcagcgccaaacaccagttttcccgtctgtgcccaagctatcgcacctgcacacatcacgcacggctccaccgtcacatacagagcacattcattcagatacttggctcctaacgcattggcagcagccgtaatcgcctgcatttcggcatgtgccgtcacatcgttcagcgtttccgtcaggttatgcgaacgggcaatgattcggtcgcgacaaacaacgacagcacccacaggaacctctcccctgtcggcagccttctgcgcctccatcaaggcttgcttcatataaaaaacatcatcggccataacttatctgcgcatatcgtgttccttgaacaaggtaggataatcatcttccatattctgatgaataaaagccaatatggtttcacgaagccagcgcgccttgttctttatctggtaagtttccagataacggtctacaatctgcacttcttcttcactcatcaggcataccatccgccgtttacgtggcggtaccgatggtggcaccttcttccgttttttcccgttattcatcattgcaaatacaaaattagtacacttcgaccaaatacaaaacagaaaatgcgtatttttgcaaaaaacaaaatggcgaagcataacgagctgggaaaagaaggagaaacagaggctgccgaatacctgataagcaaaggctacacgatacgccaccgcaactggcgctcaggcaagcgggaactggacatcgtagcgcaaaaggacggtgaactggtaatagtagaagtaaaaacccgccggagcgacgagtttggccggccagaagaagccattaccgaccggaaaatcagaaacatcatcatctcgactgatgcatacattcagagattcgaaatagacctgccggttcgcttcgatgtcattacagttacggggacagagcctccctttcagatagaacacatcgaagatgcttttttgccacccatttggtaagacatacatatagtacaacgtcaagtcagaaaaaaattatggatatagaaacactccgtcaatattgtttaagtaagcctgccgtaaccgaatgtttccctttcgacgaaagcacccttgtttttaaagtagtagaccgcatgttcctgctggtcgatctggaacatcctgaccatgcgtgcatgaaatgtgccccggattatgccatcgaactgcgtgaacgctatcagggtattgaaggagcctatcatttcaataagaaatactggaatcaggtggcactgcaaagtgacgtacccgaccaacttttctgtaaactgatcgaccattcgtatgatgaagtcgtcaggaagtttacgaaaaaacaacgggacgttttggaaaaaacatcaccacgttctactgaaaacgtgggcacgtttccggccgattatccggaaccgatatttctgagtgaaacaaattctacaaacagttacttggatgaattgtgtaacaaaacttcggtggccgaactgacgagcgtatataccgactttcaaactgccggccgcgggcagagaggcaacagttgggaatcggaagcgagagccaacttactcttcagcttcgtactttatcccgactttctggaagcacggaaacaattcctgctttcccagattacagctcttgccctacaagagctcttatcgcaatacaccgacgagatccgtatcaaatggcccaacgatatttactggaaagacaagaaaatctgcggcactctgatagaaaatgacctgaccggcgtacatatcagccgttccatctcgggcacaggtgtcaatctgaatcaggaaagtttcctgagtgacgctcccaatccggtttcactctttcaaattactggacgacgctacgaccgcaaagaaatattatgtgacttcatggaacgtgtagctcagtattataccctcttgaaagacggagaaaccgaactgatagcctcacgctatcaggctgtactctatcgcaaggagggctttcatgcctacaaggataaagacggaagtttccgtgcccgtatctgtggaattgaaccatcgggagccttgattctggaagatgagagcggaaagagaagagaatatatgtttaaagaagtgtctttcgaattataatcctaagcatgtcacctaccagccaacgaatactgcacatagctataccttctattatctctaacataacggttcccttgctgggactgatagacgttaccattgtaggacatctcggttcggcttcgtacattggagccatcgccgtaggaggtatgcttttcaatatgatttactggatattcggcttcctgcgtatgggtacaagtgggctaacggcgcaagcctacggtgctcacgaccttcaggaagtaacccgtatcttgctgcgatcggtcggtatcagcctgatgctggcactggcgttacttgtactacaatatcccatacgactcatcgctttcgaactgatagataccagtgacgaagtacaacagcttgccaccttgtatttccatatttgtatttggggagctcctgccacacttggcctatatggcttctcgggatggttcatcggtatgcaaaactcacgcttcccgatgtttatcgccattacacagaatatcgtaaacatagcagccagtctgcttttcgtctttgtttttggtatgaaggtggaaggagttgccttaggtacgctgatagctcagtatgcaggacttttcatggcgtacttgctctggctgcgttactataggcctttgcggaaatacattagctggaagaaactttttactcgcaacgccatgaaacgcctgtttcaggtaaaccgggacatcttcctccgaaccttgtgtctagttgccgttaccgtgttctttacttctaccggagccgcctacggagatgtagttctggctgtcaacaccctgctcatgcaattgtttacactcttctcttatatcatggatggatttgcctatgcaggagaagcgctgaccggcaaatacatcggagcgggaaacaaacaggaactccaccgtaccatccggcatttgttcggttggggaatcgccttgtcgattgcttttacgttgctctatggaataggaggacaaggatttttaggactgttgacgaatgaccagtcggttattgttgcttcggacgattatttttactgggtacttgccattccgcttgccggattttcagctttcctgctggacggtatctgcatcggaaccacttccaccaacatcatgctaaaagcaatggtggtagctgccggaagtttcttcctgatttattacggactacaccatacgcttcacaaccatgcgctgtggttaggctttatcgtttatctggcactgcgaggcatcgttcaggcctggctgctcaactcttcgagcctacgaacagccaagtgatgtttcttctcggcagctttccgataccagtacaacgctttttccctgtccggtgcgccaatccatccttcttcataggcttgtccgatgcgataaagggcatagatatcttccgactttttatatgcttcgaaagcctgagggagggatacgggtaaggttccacagcctttccgatacaaatcacccaaattcgtaggagcgtataaatgatctccctgaaggtaagcctgcttgaaccagtactcagctttctgtccgtcacgttccacaccgataccttcctgatagatagttcctaaatcgttcagcacgactcccgctacatccgctccagcccgataactttcaccgagagccaccagcatttctgtatcttcacgcgaataactttcccaagtttcggccccgtctatctgccaggacttaactcgtccaatggaaacatgctgaggtacatcgacttctgtctccatttcttcccgccgacgatcttcttccagctcggcatcggtagcctggggaagcagacctttccgcatgatatactgcacatagccataaatgcgtggcgtggaagaatgaagatttaccccatattgcgccagtaatgccaacgataaataaggggttccttccaatggaaaccccacatagtaacgtggaaacacagacaatgccgatttcagcattgctatttcttctccaatggcatcttcaatccatgcttcatcgtatattcgatacactgtttgccccgcctcatcgggaaatgtcaatgtggtatgattgaggtgttggcttaaacaatccagcaggtagggaaaaaacttataatcgctataagaggccagcccgtctatcataacttcatattcatccggcccctctgctatgacaaacatggttgttgagatttccggacgagtgaaataataatagctgcgttctccgtcgtaaccttcaaattcaaattggaaaggaacatccagttcacgcaagaacgtatccaaatctaacttggccgatgaatgtatgcataccgatctcatgcttcctcttcctcctccgtaccgtccaacagatattctttgcggaacatgtcaaggaacaacaggaataatgacaccagcaaaggtccaaaaataattcccataaatccaaaaatcggcagtccggccacaacaccaaaaattgtaatcaatggatgaatattggccattttcttctgaagaatgaaacgaatcaggttatcacactgagagataataatacctccatatcctagcaggataagcgcatttacccattcacccatgatcaggaagtaaacagataccggaacccaaatcaaagccgtgcctaccagcggaatgattgaagcaaatgccgtaagcaatgcagtcaaatacggattgggagcatcgcacagccagtatcctcccaaagaaataacaccttgtataacagccagcaacggaataccgatggcattcgagcgtaccatcaactggattttattaagaacttcacgcttgttactttcggtaaagggcataatggtcgatacataatgttccattttcttgccttcccacaacataaagaacaagagcataatggctacagccagattaacaactaaatcgcttaccccactcatgatcttttggccgatggaagatgcctgggacaccataaacgataaactttgttctgacagcaagtcgaatccagtccgttcctcaatgatatcgatagcctgacgtgcgggctgaatgattgactgggtatcaaaatgcattcccgaaatctgacttacaatagcccaactgaacaacgatagaggaatcaaaataaagagtgttactcctattgtaataatccagactgccagaagcggttttatcttgctctgaagccagttcgaaaaattacgcaacaacagatataaggtaaaccctcctaatatgccgttcatgaacggctgtgcctgacgaaacaacaaaattcccaatccgatgataaaaataatgagagaatatttccaatattgttctttcatactacaaattttcctttttagtcacaataaataactgtaccacttgggggcaaagttacggaaatatacttatcaacaagctatttatcgttttaatatcataaaaaagtcgtttatagtcatctgttcatgttttcaacacaaaacaaacgttccataaacgactccgacatttactaaattcatcattcagtgcaatgtctctcatattacctaaaaaactcccaatacctacgtatgctttaccggactattcgataccgatttcatctacaaagatgaatgcaggtcggccacttccccaatgccatgcgggaatcttatattccggtttagcgatcaccttaacataacgagcatttatagaattgaactctacttcgtgagtataaataccatttttgtccttagaagtgacaggaggaaagtcaaccgttttcaactccttataaattttaccatcatcggatgccaataccgaaatgcttcttacgtctaagatttcttctccaatctccacataagtccgtacccatgctttatgaatggaagtctcctgctttaaatcgactaccgcctccatatcattcttataaaacgcaatccaccgtcctgttctgtaattgggtgttccacttaaaccatctaccaatgtatattcaccattgaatttatatttctcattgatcggctgcaataatgtcaaaggcttgacagtagctttattgaaatcgattttttctgtaagaacatcactctttttattattacggatagtgatagctttcaaaacacaactttctttcaacgaaagtgtatcaccatacaactgggacttttccgtaggttcactaccgtcgagcgtataataaatcggtgaatttccgatagcagacaacaccaccttaattgaattatttacataatctgtaatatattccgccttaacattaaaaacatgcttagcataattatatccttcccgatcataaattgaaatcaattgcggcaaacgttgcaggaagttatcgtaattctttttatcgggcatcgtccattggacttccgacaaggcagccagacgaggtaattccatatactccaactggctaaaagtgggaacatattctgtccataaattagcttgaactccgatgatatgagtagcctcatcagcagtcagactcggatcaatcggttcatagctatatactcgttctacagacacatatccaccgatagccaacggttccttttcagtatccatcgtctgataataatcgaaatataaatgagaagctggagtcatgatagcatcatttcccatctttgcagcttcaatgcctccttccttgcctcgccatgacataactgtagctgtaggactcaatcctccttccaggatttcttcccatcctatcatctttcgtccctttcctttcaagaacttctctgcataatcaataatgtaagcttgcagtttctgctcagcagtatgcttatcgtctgccttgatgcccaaagctttaatgcgagcctgacatttcggacacttttgccaacggactttcggacattcatcaccacctacatgaatatattcggaaggaaagatttcaacgatttcacccaatacatcttcgataaattttagagtttcatcgttaccggcacacaacacatcatcggaaacaccccattgcttccagacttcatacggcccgcctgtacaacctaaataaggataagcagccaatgcagcctgcatgtgtccgggcaaatcaatttcgggaataattgtaatgaagtgatcctgggcatattttacaatttcacgagcctcatcctgagtatagaaccctccatagggcacatgatcgtattctccagaattacgacccgccaccgtttccgcacgtttagaaccaatcgttgtaagttccggacgtttctttatttcaattctccaaccctgatcgtctgtaagatgccagtgaaaacggttgatattatgcaaggcaagcatatcgataaaacgcttgatagaatctgccgggaagaaatgacgtgaaacatccagatgtaccccacgataagagaaacgagggtaatcattgatttcaaccgcaggaaaagccacatctgcatgtccggcttcagccatcgacttacgcaatgtctgaataccataaaagactccggcagcagaagcaccttgtacacgaatcaaatgcttttcaacttcaagatgataagcctctttatttttattatccagccccgtagacaaaataatggcattcctatcgacggacttatctgtcacttctaactccttccccgtctgttctttgatatatccagctaaaaattcagcattacgtttcatcgtatcatcaccagctggatatacaataacggtattgttgttcaaaacaaaatcaccaacagcagtagtttgtatttcttgcggcaacggaatgacatcaaaattagcctgatcttttatagccgacgaacaagagaagagtcctccacacaaaagaagcaatcctaaaaagtacaggtttttcattaaaagatgattgattagttaacaaaataattattagaataaatacactatttctccgaaatattggtatagagaacctcaatctttgaagtactacatcaacacttcgatagaaacattctatagaaaataaaaaaacaaccgatatatgattatcggttgttcttatttaacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgatttaatcaacaaaataatcttttattgatacatatacactgagaatctcgtaatatcaacacgaccaggaacatcaatcatctgatatttcaagaaacgagtgtttactctctgattaaacttaatggtttgcagataactacttgtttcgaacactcctattgacttccaactacttccattgtctgaagtaaacaactctacttttgttggagcatacatatttgcccaatgctgagtctgtatacctgatatagtttttacagatttaaaatcaacagtcaaccagaaaggaactccattagtagccacatcattacttcccgttcctgccacagtattagctcctgggttttctactccgtccataaaagtaaatatccattctttcggtgtagtaaccaatacatcctgttttggtttctccgctgctttcttcactgtaaatgcaaatcctttattaaagtcactaacagtaactccttgagcattcgaattaatagatttcatgttaattttaagaaagtattcagcagccgcttttacattaatcaactcagaccagtcagtaatactcaaagttataggttccgactgtttttgtccagcttttattacggctttttgtgaactcaaagcaattttattcgcactaataggaagatccgtagttacttcaatatctacagctatatcttgatctaccggttttgatgcaacagctataaactggaagtctaccttaccttctattcctataccttccgaatgggtcaaattaaactcagtagtaagaggtttcaaataatcaacaggaagcaaggagatataacttagattccattcattaattgtttcatcgtcgtcactacacgatgtaaaaggaatgactccccctatcagggcggccattaatatataatgaaaaaaactttttcatactattagtctttatttcattcacctctctgtctgtcagagaggtgaattattattaaaaatatttatttccaaggagttgccgtttcagtagacaagataccttctacccaagtaaccttttgtttagtttccaaagtatgtcctttacctgtcgcatcttcgaatacagtgtaagtaccatcacttctttcttctgttttgccttcattcatacgccaatatgcttccaatccggtagactttggactcacctgtgtcatactgttctgaatctgagctgcattacgagctacagaccaaatacgtatctggcttaccaaaatgttacaaccattccaccaacctgactgatttccatctccatcagtaaaccagttaacacctttgaatgtcaaacaaggagtagcacactccaacttaccactttcaataccatttacataaattcggtaagtagttccatcgaaagtcatagctatatgttgccatttattggtttcaaaatgattagcagggttaacatacataccctcatgaagctgaatctgaaccaacgagtgggcaggatgatcactattagcagactgaggatcttcaaaacgcaataatatatagcgaccggagccgtcattagttgaaaatacagcacggttacgattatttgtattactaatttggaaacgtgcttctacagtatactgcgcataagtttcaggagcagagatatactctggtgaatataacttagcacctccaccaaactgaggagcagagaactgaataatattttctgctaaaataacataagttcctgtattaggcataacagggtagttaccatccttcgaaaccagtctgacaggcaatgcataagcttctcctgaatctaccatttccttggtaaaggctttcaaagttattgttgtttcttcagcattatattctccagatttaataacaatatcttcgggcaaaacatattcaccttcaggaatggttacgtaacttgtaccattttgtttattatattcatctaatatagaagaatctactacaagcttataatgactatctatagaagcagcattactcatatgaatattgatcgtagtagtggtttctccagtagcctgtaccgttactttcgcacctgctccattaagggcttcttgtatataagcatgattatcaagagcagaatattctgcatcatcacatgctgtaaatattcccacaccagctatcaatgctgagaagaaaaatgtttttatataattcagtttcataatctaattaatatttaagtaatgaatgtgaagaaggattcataatttgaatggccttgcgcatatttttacattctggagtagtaccaaattctgcttctaaatgataaactcctacaccgcccttattgaaaccgtttgtaggtttccaacgagccataccttccaatgacaacatagaattaccataacggtctctatatgaataacctccattcattgccgcatctacagcttcaaaattttctgtcattatcgtcatattagtgactctttcttcaccaagttcttttccaaaagtttccatcaagccacaacgatatgctccaggccctccaagaagtctaccatctaagttagaatcacttccaggattgtaagcttgaattacaaagtagtcaaaatagtgtccaacttgaggttgatctgtaatactttgaggctctccatcaatcaccaataatttacctgtccctgattgtggtcccaaatatttactaagttcttcaaggaaaattgcaaatcgtgaattattacctgacattacaagattacctacataaggaccagcattgggttcataatcaatatcaaatccatcataaccataatagttaattgtatcggctactgctcttgcatatttacgaatagcagcttccatagcctcctgatttgtttcatcaaatccccaaaaagcgttaatcgcttcacgatcacttccatatccattttcttcccagttatcagtaacataagaaggagtaaatccatctcctacactaccaataatttggcaaacaacaacttttgttccttttacttgctgaacaaaagctaaatctttcttctgcttttcagtcaaatttttactgttgttccataaagaaacaatatccaaactatcaggaagtccagccaaagagtttttcatataagctccatcaccagtccatcctccataccatccaaaagaaacttgatggtcactctgtttataggcacgtaatgcagcataatattcatcagaagttacttcttcaggaaacgactttgcttccatatctgtccaatcactacaacctacaaaaatggaagtcagtaatgacaaacataaggtatataataaagatatctttttcataaatattcatttaatgttattagttctttttagcccacttcaaatcggtagcctcattatcagcgcctcccaattcagcaactccttgattataatttgtagtgttattctgtgcttctgtatatgggaaacttaaacgacgcatacctcttgtactgctgacaccacaatctgaaaggttatcgatacatggatacagttccggatatcccgtacggcgatattcagcccatgcctccaagcctaacggataattggcaatccatttctgagtgataatacgctggaagttcttacccgtaagagaattgtcactgtcatcccattttacagaaactgtattggaaatagtagccgcagctctctgtacattatcactggcatgtgatacggtaggagctttatctattgccaaatactcatcacccgatacagagtattgttccattgaaagacgtatacctgtttcataatattctttagccttcttatctccaacattccatcctctcaaaataccttctgcacgcaggaatgctgtttcggcagcacagaataccatcaacttatctgttccggtaatagctggtgttgaaaatgcagcagcatctcctttcgcaaaattgctgtcgcccgtacgcattccaacatattgatctgttttgccagccatagtcgacttattgaaatacttaggcatacgtggatcattataagcattcatatagtcaacaatgtttgcattcacacgcaaatcaccccagctgacagctgccaactgatatggatttgtctgtgttccgcaatccatcatcgcattatctacatttgtttcaatcaaaccagccggatcagaaacagccgcttctgctgcctctttcgccatctcaggccatgtatcgctgatacgtatagccacacgcaaacgcatggagttagccaatttagcccattttgaataatcaccattgaacacagggtcattcgagcctaaaggagcataaccacttgtacttacataatagttatacaatacacttgccgcatttcccaaatcttccagaatatgcttgtacacatcttcttgagaatcgtaagctacatagaaattacccttctttacctgactgtaaggcataggaccataacagtcggtcacgcgtaacattgttattgcacgaatcatgcaagcaaatgcataatagtgtccagtagaattggttgcttcctgaatctggaagaagtttccatagattttctggtaagaagtattccatggactagctgtccaggaatcactaggattgaatgttccaaagttagtaccactccatgtattggaacaacacagatagccacccagctgtcctaccatctgatccatcatctgagagtcattctgttgaatattgacaatagtttcaatcattgacttcatcaatgtggaaggatcagcctcgtgaatctgatactgattagtattatattcttcaaacttatctgtacagcctccagccaaaaccaataaagctgcacccaaggttatatttttcaaatagtttttcataataggaatctcctcaaaattagaattgaacttttacattaaaaccaatattacgcaaacttggctgcataaaatagtccacattcatataatagttacttgcggtagctgccgacaattcaggatcgaaaggagctttacaataaatcatccacaagttacgtcctacaacacccaaagtaatattggctacattcttaaaccattttttaggaagagtgtaattcaagctcaattcctgcaaacgaacgtttgtcgcactatacaaatagtaacgaccatatccaccttcaccggtaccaattgtctgataatatttctgtgcagtaaccagaccattattaataggaatgcctccattgtcacgagctgtagcagaagcttcggatacaccatagtaatccaaaataccttgcgtagcagaataagccaaaccaccaactcgagcagacaatacaactcctaaatcaatacctttataagtaaagtggttagtccaacccaaattgaagtcagcatccaaatcgcctaccttagtcggggttgaagaagaagtcatcgacagatttccgttttggtcaaccttgatattaccgttattatcgcgagtcaactggttatatacataaatatctgtcatagagccaccttcagtcaagataacacgaggcgctacgttttccttacctagccaaccaacaggcatgttctccatttggatttcttctcctgtaacaggattcacactaccacttgccagacgaataaccttattacggttcaatgtaaatgctgcattcgtagaccagccaaatccagcccattcatcgtggaaacctaaacctaattccacaccctggttctgtacattaccagcctgaacaatagccttattataaccagaagatggaggaatatcaacactaaatgtttgattcaatgtatttgaacgataataagttgcatccaagttgaaacgattttcccagaacttcaagttaagaccaatttcccatgatttagttttttccggtttcatatcatccatcggataaactgtcggattttcccagttatgagtctgtgcattgtacacataacccggattggtcaagaaacgatcaaacgaagaagccacaatagtatatgatcctcgaatctttgcgtaagaaataacttccggcaactcaagcatatcagacaatacagctgacaaaccgacagacggatagaagaacgaaggatgtttagagtaagccaacttagaatcccagtcgttacgtcccgttacagtcaaatacaactgatttctccagcttaattctgcacttgcgaaaacactctgaatttcatcatcatatccttgaggatccggcttgtagttagccgaatagttgatattattcatctggaagaaattcggaatcttcaagtcgccggctatagacaactgattcatggaagtatgatagatagatgcaccaaagttcgcattcaaacggaactctccaaatgtcttgtcaatattccccagaacatcggcataaattgaacgttcctgacgcattgcatcttccagaccaccattcacaccacagaaggtagtcaacgtagaagccgacttttcgctgcgattgcgataatccgagttatccagattgacacgtcccgtgatattgaaccagtcggtcaccttccatttcaaagaagcgttcaacatataacgtttcttttctgaagtacgtaatatcttgttctgaatccaataagggttctgcaaagacataccaccatcaccataaggccaatattgcttcatgtaaccgtagtctgtatcgtaacgttcatacaaacgaatttcatcgaagttatcgccacgcgggaacaaatacaaagctggcagcgggttgtaatactgtccttgtgataccatgttcttgttattctgaataatgtactgagcaccgatatccaatgtcaagcgatcattcaaaaagttagtagtattacgagcagtaaagttataacgattatagctgttattcggtaaaataccatcagaattggttgtagaagcagacagataagtctgattcttagcattaccggtagacagagctatagagttaatgatgtttgttccagtgttaaagaagtcagacggatcgtatcttctatcagttgcagcaccccagctaagcaaaccagcacttgtaccataacggttctgcatttcaggcatgatataagctttggagaaagtagtactattcgatactgtaagatttgttttttcagtctgacctttcttcgttgtaatcaaaacaacaccatttgcagcagcagaaccatacaaggcagcagcagacggaccggtcatcatgctgacactagcaatatcatccgggttcaggtcggctacagcatcagaaccacccatagatccatattgtccttcaccaccacttgaaccagtattaaagacaggcacaccatcgattacatacagagcattgttatcttttgtcaaagatttcataccacgcatgacaacacgagctgcaccaccggctccagttgcaccactactgatctgcacaccagcaactttaccagccaatgagttcatgaagtttgcatccttcacagctgtcagagcatcacctttcacttcctgtacattatagctcaaggctttctgtgaacgcttgatacccaaagctgttacaacgacttcatccaaaacttcagtgtcctccttcattacaatttgtcccaacttagcgcgaacaggcaaagtctgagtcttatatccgatataagagatttccagtgttgcaccttcatttacagataatgtaaagttaccatctatgtcggtaattgtaccgttagtcgtaccaacttcaaggatacttactccaatcagaggttcgcctttagcgtcaacaacctgacctgttgtggtgacctttgccacagaactagatgacaacgatccattagatactgaaataccactttcggtagcatacaatgctacattatgaccagaggcaatcagcaaaaacaagagtaattttgataatttacttcgtttcatagattaaggtttaatttgttattaatttaaggtatctaccttttaaaagcgaatgcaaatataactattttatatatatatcgtgtgaaaataaaataattatccttgtaattttaaatataattaattaatttaaaattacaaggatataaaaataaattacttaatatatcattttattttacaatgatttcatcaacaaattgaatgccatccttatataaagaatcagccatagcctgatatctgacataacgggcatccgcttctccttcccagccaaacttcttaaatgacacagaatcatctttttgtacttgatgatgaatggctgtcaactgagtatattcctttccatcgacagaagatgatataataacttccgacggcatgaatacataaggcccgcaaatctgcataaattcggcagatactgaatgaattttcattactttttccaaatcgatgaccacatccatccgatggttgtctgcaaagcccagccaacgcttatcgttataattccagcctccacgcaagccatcgttcaaggttttttcaccgtttgccggataatttggccaataagggatattaaaagtaacctttttgcctactgccagatgttttacaggttcaccatactcttttctattgcctatttccttagcataatcgaaagaattatatcctttagccttcaattccggaataattttcaggattcgttcgcggaaagagtcccatgattttctttccggcacggtccatgccacttcggccaaagcaatcgcacgcggataaagcatatactccatatgttcatcggtcggaatatattctgcccacaaattagcctgtacacccaaaatcatcttccggatatcggtgctcaaagaatcgggtactggattataagaataaaccttattcaaaggaagataccctccgattgcttccggctgagaatatggcgcgtcctgataagcgtcgaaataacaatactctcccggagtcattattgcatgatgtccggacaaggctgcatcgatacctccctgctcgccacgccatgacatgacggtagcgtttggagccaatcctccctgaaggatttcatcccatcccaacaggttgcgtccatggtcattcaggaaacgttcaatacgatgtatcaaataactctgcaattcgtctacatctttcaggccctcttctttcatgcgtttctgacacaacggacaggttttccatgaggccttcgaagcttcatcccctccgatatgaatatattcagaagggaagagttccataacctcggtcagtacatcttcgaggaactcgaacgtcttttcatttccgacacagaaatcagactgcttgcccggttcgtgtgtacacgacagttccggataggcggccagcacttcattcgaatgggaaggcatctctatttcaggaatgatagtgatacaatgctgacgagcatattcaaccatttcgcgaatatcatcttttgtgtaataacctccttgtgcctcgggatcggtttcttcgcaatagttagcaccactattagaccattctttccatgtctttccttttctccaagcagcatactgagtcagacgtgggtatttgtcaatagcgattcgccatcctgccgcatcggtaaggtgcagatgcagtctgttgaatttataatgtgacaatagatcaatctgttttttcacaaaatccttcgagcggaaatggcgggacacatcgagcatgataccacgataagggaaacggggttcatctaagatttctatagcctgaacacttccctttccttgttcagccaactgtatcaggctctgtacgccataaaacaatccggcatccgacaaagcttttattactactccatcttttccgacatgcagtgagtaagcttcaggggatgttactccaccgattgagtcgaccacctccagccgaatgcaatttccatcatcactagcagtaccaaagacaaccgggaaagtggtttcagaaaatgccgtttccataatcttctgagcatccttattgccatcgaaagcaatatgcgtatctttattccactcaaaggaaccttcaccaaaagaatacgaaagaggctcgggcgtaatgcccacatcttttttggttgtacagctgccagccagcaacagaacaaaagcaacaagagacaacaatgaaactttcatatactcattagtttaaaattatttcatcaaccagcagatacggggtaagtcctgcattcaaatgccattcgggcatacgcttttcgcttacaacctttatcttgacataagtggctttacaaggctcaaacgatagtttatgctcggcaatggtatcaccgtccgagggctgcatggcaggataatcctgtgaggcaacttctttatagtttttcccgtcgctggaaacggcaaccgagaatttcttcgcatcgaacagccatgcatcttttctgacataaacatgaatagtagccgaactcaatgtagtttcgccttgcatatcaatgacagcttccaagtcgttgccggcaacagctacccacgctccggtatcgaaactatgatttccacggcgaccgtcgaccagcactaccggaccgtcggggctgaaactttcctgattgggctgaagcagcttgacaggtttcagcgtcgccttattgaaacggatggtatcgatggaaatcttgctcgtacgtgaagggtgtacggccatcgttttcagaatggcatccttatctatcgtaaacggacctgtatacttagccgattcttctgtaggatcctgaccgtcgagtgtataataaataggatcgtcggccatggtactcaactgtacgcttagtacgtgtttcaccgtatcagccttaatatctacatttacatcgaatacgtgagtggcatatgtccagtcgtagcaatcgtatatggctgtaagccgaggaatacgggtcaggaaatctttataatccttacgggaaggatcgctccactgtacttctgccaaagctcccatgcgcggaagaatcatatactgtacctgactgaaggaaggaatatattcggtccacagattagcctgtactccttttatatattgttgctcttcctttgtcaactctttaggcataggttcatagttatatgttttttctatcggcaaatatccaccgatggccagcggctcgtcttctacctgtttcgactgatagtaatcgaaatacatataagtattcggagtcataatgacatcgtgatgctgacgtgcggcttcaatgcctccgctttctccaatccacgacatcaaggtagcacccggaaccagtcctccttccagaacctcggtccagccgataatctgcttgcctttttcgttcagacacttcgtggcttccgcaatcatataactctgcaaacgttcctctttagtatgcttcgcattcgatttcagccctaacgccttgatacgtgcctgacacttcggacattctttccagcgtacttttggacattcgtcacctccgatatgaatgtattccgacgggaacaggtcggctacttcagacaatacatctcttacaaactgcaacgtagaatcatttcctacgcacagcacatcatccgatacgccccaggtttctctcacctcatacggtcctcccgtacatcctaactccggataagccgtaagagcagcctgcatgtgccccggcaagtcaatttccggaataatcgtaatgtaacgcttggctgcatagtcaatgatatcgcggatttcgtcctgcgtataataaccgccataaggagttccgtcgtatataccactacaccagcggcctaccaccgtttccttacgctgcgatgccaccgacatcagcttggggtatttcttgatttcgatacgccatccctgatcgtcggtaaaatgccagtgaaaacggtcgatattatgcagggcacacatatcgataaaggtcttcacttcgtctaccgtaaagaaatgacgggctacatccaacatggccccgcgataggaaaagcgtggcttgtcgtaaatttctactgccggaagacttacatttatattctgggcaacgggcaaagactttctcaaggtctggattccgtaaaagactccagcttcggaagctccggaaatacaaatccgcttgtcgtttaccacaagtttataggcttctttattatcgtcactcaaatcgagcgtcagacaaatagcaccgtcgacaggcattccggcccggggattcagtttcagccccgtctgtttggctacataagtcgccaacaattcagcattttcacgcattctttcattattttccggatagacgacggtaattccatcttcgagcagaaaaggagtacttccttcactcttcacagtcaaaggtttaggaataacttcataatcagaacttaatgtttcttttgaagaacaagagaaaagagtactggacagaaaaacacagagcaagctcatgaagctaactgaaatttctttcatacggtaagataagatttaagtgtaaactaaatatggtaaaacactcctttcgagtaattaccatatacaaaggtaaaaataaaaatcagagaaaccgattaattaattaaatattttacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgattttaagaatagatagtgaattattttcataacaaaaaagtaaatcagggaaaagacatatattaaattataaattatccgaaatgcaacaaaaataaaaacatattggatcatatccggacctttctccagcatatagacagtttgttaaaggttgtaaagcagcatgttttttaatgatatcgggagatctccgccaaaacgtctcgacgtttttttaagatttgtacaaattcttattttttttgtacaaatctttaatgactttccagcatacaaataaaaaagaagctaaacggtatccgaaaacaaccgcataaaaagacattaccatagccatacgattgattttcaagcagaaacagttgcatcttatcgtatttcacataataaaaaagcccggaaacattccgagctttattccaattcccgaagaacccttaatcaatattaaccgtccgccttcaggggaaatatctgtatcgacactcaataacttctgtccatgccagacatacagtattaacctttctttcttttcttccaaagttgccagctattgattatattctgccatacgacatagcttcccggtgctatcgccgaaaccggattcaggtaggtacatgccatccatattgccaggactgtattcttctgccccagtgcctgcccaccgctgatacggtcggagtacaaacctccgatgtttttcccggcccagaactgaaggcaacaaacgacaagggcaaaaaatgcaatcagaaattcttcgccgatggaagtatctccctcgactaccgacttggtggtctgtcccatcacgataatcaaagccactgcccacagataaaacgccatgtctttcagacctaccagaaagcgatgaaccggcggacagaagcggcgcagcaacacagccgtaaagaaagggaacagcagcaacgggaagaccttgcccaaaatacgaaggaaagattcaccgaaagccatgtccgaaggctcgaccagcggaaaaaccagtggtacgataacagcagccagcaaattcgacagcaaagtataggtagtcagtgaagccgcgcttccacccaactttccggtaatgacggcagcagctgtggctgtaggacaaatcaagcaaaccatcgttccttgcagagccacgctccagtattcatccaaaggtagaaaaatcagcaaagatgctattatcacgcaagatacgaactggataagcaacagccagattgtccaacgctgcggcacaagttccttgacttctaccttgcagaacgtcaacaatagctgagcaaaaataagaaaaggagtaagccatgctatcattacttttacaacaggctttgtcggagtcagaaaatcgaaagcggcaaaacagaaatagccgattaccccgacaagcatggcaaggggaagcgtccaattttttataaactgtaacataaatgttctgatttaacgaacggcaaaattacacaaaacccatgaaacatattgtatttttaattgtttttataggcgttatctactgattagttaattcttatcaacctaaatgaagatagagtacaaaaaaactattacctttgcaaacggataagttatatgaaaaagaatatattcaacatactatatatcatttgtatcttactgatatccggtcagcccgagcacgtacaggccgcccctcagaagcgatttaccgtagtcatcgacgcgggacacggagggaatgaccccggtgcaataggtagacgtggacgcgaaaagaacatcaatctgaacgttgcgctgaaactgggccgtcttatcgaaaacaactgcaacgacacacgagtcgtttacacccgcaagaaagatacatttgtaccgcttcatacacgggctgaaatagcaaacaatgcaaaagctgacttgtttatctcgatacataccaattctgtagcctcacgaagcagcaaagtcagtggtacggaaacgtatacattaggattgcaccgtacacaagacaatctggaagtggcaaagaaagaaaactcggttatcttgatagaagacgattacaagcaacgttatgccggattcaaccccaattcggcggaaagttatatcatcttcgagttcctgcaagataaatatatgtcgcaaagcgtaagttttgccacaatgatacaacaacagttccatcaaagtgcccgccgggtagacaagggagtacatcaggcgggattcctggttctccgggaaacatccatgcccagcgtattgattgaactcggatatattaccaatcctacggaagaaacctatctgctttcggacaatggctcttctgcactggcaaaaagtatctatcaggcattcctcaattacaaacaacgcagccgtaagagtgcaacaagcgtaatgcctgccagcgaaccggaagaagacatgatggcagaacaacctgtaccacaacctgaaaacatagaaagtccgcaaagtcaggaaacaattcctgcacaagaaccggtacgcagtgcttcaaaggaaagttcaaaacaagaaacttccaaaccggtattcaagattcagatactgacctccgacagagttcttccgtcgaagagcaggctactgaaaggactttcgccagtaagctattacaaggaaaatggaatttacaaatacacttatggggaaagcactgactacaaccgcatacttcgcctgaaacgaaacaaagtagacagcaagttcaaggatgccttcatcatagcattcaagaacggagaaaaaatgaacatcaaccaggccatcagagaatttaagaaaaacagataataaaaagaatccagatagatatgagaaaagaagtaaaaataggtttggcaggaattgccgcattgattattctcttttgtggagtcaattacctgaaaggtattaatatgtttaaaccggaaagttactaccatgtagagtttaccgacattaatggacttgcacaatccagccctgtgttcgctaatggcttcaaagtgggtatcgtacgcgacatacaatacaattatcagaaaccgggacacgtagtagttggcatagaaatggatgaggaaatgaaaattcctacaggaagtagtgccgaactgataaccgaaatgctgggaactgtaaagatgaacctgttactgaaccacgatagtaatacatattataatgaaggcgacacactgccaggcgtagcaaatacaggaatattgggcgcagccgaaaaagatttgcttcctaaaatggaacagatgctgccaaagctggattccattctgggatcactcaacaaactgcttgccgaccctgccctgagcaaaaccctgcataacgccgaacaactgactgcatcactgagcgcaacaagcacacaactgaacagactgatggcaacggatgttccacaactgaccagcaacgtaaccgctattacagaaaatctcaagacgatcagcgataatttaaaaggtattgattatgcatctactttggctaaagcagactcaacccttcataatgtatatctgctaaccgataaattgaatagaaaagacaacactttaggactgctgatgaacgattccagcttatacaataacctgaatgcaacaacagccaatgcagccagcctgctggaggatctaaaagcacaccccaaacgttatgtacacttctctcttttcgggaaaaaggataactgattttcgttatatagaaatattctaaataatcaaataagataatctcctacgagataagataataactcgctgatattcaaccaaaagatattagcgagttattattcaaaaaggggaacacaaatatataattatttgagaaacaacttcttgcaaaccgacaaatctgaacatttttcaagataggaaagaacggcaataatatactgatttgcaatatattacaagaataatcaaaaaagcaagtaaaaagacatttgtttttctgaaaatagattacgaactttgcaagcgtagaagtttcgctttattaataacagattaaatatgattgagaacaatcaggctattgtattatggaaacgttgcttgaatttcataaaagacaacgtgaatgcgacagcctataaaacatggttcgaacctgtcgtaccattaaaatttgaggataaggccttgacaatcggagtccccagtcctttcttctatgaatacttagaagaaaaatatgtgggacttttgcgtgccgctatatataaggagattggtgagggaacagaattgatgtattctattctcaccgataagacaaatcatatagctattgacatgaaagggacagagcgctcgtctgctttgcccccgcagactcctatacataatgctaataaagcacccagcctgctgcaagctccggctgtacaggatctggacccgcatttgaatccaaactataatttcgaaaacttcataaagggaaccagcaatgagttctctagaacagtggccgaaactgtagctcaaaatccggcacgtacattcaacccgttgtttttgtacggtccgtcgggtgtgggaaaaactcacctcatcaatgctatcggtacacgtatcaaggaattgtatccggaaaagcgtgtgctctacgtttctgctcacttgtttcaggtacaatataccgactctgtacgtacaaatcactttaatgatttcatcagtttctatcagactattgatgtcctgataatcgatgatattcaggaatttgccggagttacaaagacgcagaatactttctttcatatcttcaaccacttgcaccagaacggcaagcaattgattcttacatccgaccgtgctcccgtaatgttgcagggtatggaggatcgtttgttgactcgtttcaaatggggacttgtggccgaactggaaaagccggatatcgaattgcgtaaaaacatcttacgtgacaagatccgtcgcgacggactggttattccggaatctgttatctgttacattgcagagaacgtaaacgaaagcgtacgtgaattggaaggtatcgtaaactcactgctggtatattctatccagctgaagcgcgaaatcaatctggacttagctcaacgtattgttcgcaaagctgtacgctgcgccgaggtcaagccgcttactgttgacaatatcattgaaaaagtatgcagccattacaaagtagacgcttcaacgatccataccaagacccgtaaacgtgaagtagttcaggtacgtcaggttgctatgtatttagctaaaaaacatacagacacttcttcatccaagattggtcaactcatcggtaataaggatcatgctaccgtacttcatgcctgcaagatagtaaaagatcaggtggaagtagacaaagcattcaaggctgagattgaagaaatagaagccagcttgcatcaaaaataaagatgaaaacatcggtacccgaagaaaaaggaaatgtattacagctaaagattcacattcccaacatcccggattatcatcaaattaaaatagaaatcgccccctctgaaattcaaataaaatttttgagagggcgatttttattatttaaaatttccccagccctgtgctaaagcacctgttccactttccaatcaacgcagaacagaaaaaagaaatacaaggctggaaactgagtaatattttttatttatcaaatttctgtgctttcagcgttttcttcaagatatccgacatagcttcattgtctgcctttttataacggatatctgtaaaaatctgcgctaaagtctcggtatgattgatttctacaaactgtcggttttcaggaagagattctttgtaagcaaaaatttcatctatatcttccggtgtataatcatgataaacttctttgtgtataataccctttatcggcaaacgatcgggctgagcaggagattcgtcagggtaaccaacggttattgtcgcaacaggaacaaccagttccggcaaatgtaatatatcaattatctgatgaggattataaatggtagttcccagaaaacaagttcccaagccattttcctctgcaatcgtacagaaattctgagttaccagcaacgcatcggtcattgcattcataaaagaaagcagattatcgtagcccggctctgccttccgctgacggcaccatttgctgaaacgattgaaatcagcacagaaagtcagaacaaccggagcagaagtaaccatcggctggttaaaatgggcaggtgccaatttagccttcatttccgcatcgcgagttaccactacactatacaactgcatatttcccatagtcgcagcacgaaaagctgtttcaagcatctcattcaaaagagcagcagggatatcctgagtcttgtatttacgtattgtacgtctgttttttatagaatccataattaatttttttaatttatctacaaacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtacaaagatacaaataaaaaaataagtatataccaatgaaaatataacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgaatataataaacacgtacaaaataaatagttatacaaaactgtaaactttaagggaatacatcaagcactacaatattaattatcaaataattacaatttaaaaacggaaaactttataatttgttgataacttctttctgttttattttgcaaatcacaaaaacatctttagctttgtagcagtttattattagataaagcgaaactcctacataaaagaataataaactaatatcattaatataaaagtggaaaaacaaacgtatagctatgacgaagcttacaaggcctcgttacagtattttaatggggatgaacttgccgctcgcgtgtgggtaaacaagtatgcagtaaaagattcctttggaaacatttacgaaaaatctcctgaggatatgcattggcgtatagctaatgaggtagcccgtatcgaggcaaaatatcctaatgctctcagttcggaagaactttttggattgcttgatcactttaagtatatcattcctcaaggaagtccgatgacaggtatcgggaatgattatcaagtagcttctttatctaactgttttgttatcggtctggacggatcggctgactcttatggtgcaatcatccgcatcgatgaagaacaggtacaactgatgaaacgtcgtggaggcgtaggtcatgacctttcacacatccgcccgaaaggttctccggtcaagaattccgcactgacttctacaggtctggttcctttcatggaacgttattcaaactcgactcgtgaagttgctcaggacggacgtcgtggagcactgatgctgactgtttctatcaagcatccagattcggaagcctttatcgatgccaaaatgactgaaggaaaggttacaggagcgaatgtttctgtaaagctggacgatgaattcatgcaagcagctgtagaaaatcgtacttatacccagcaattccctattgattcggataatccacaagtcaaaaaggaaatcgatgcctcagctttgtggaaaaaaattgtacacaatgcatggaaatcagcagaaccgggcgttttgttctgggataccatcatacgcgaatcggtacccgactgttatgcagacctgggattccgcacggtttcaactaacccatgtggtgaaattcctttgtgtccgtacgattcttgccgattgctggccatcaatctttattcgtatgtagtaaatccgtttactccggaagcctatttcgactttgagctgttcaagaaacatgtagcattggcacagcgtatcatggacgacatcatcgatctggaacttgaaaagattgaaaaaatcatggaaaagatcgattcagacccggaaagcgaagaagtaaagggaactgagcgtcacttgtgggaaaagatttaccgcaaatctggcttaggacgtcgtacaggagtaggtattacagccgaaggtgatatgctggctgccatgggactgcgctacggtacagaagaagctaccgaattctctgaaaaagttcataagaccattgcaatcgaggcatatcgttcttctgtcaacatggcaaaagaacgtggagctttcgagatatacgatgctgcacgtgaagcaaacaatccatttatcaatcgtataaaggatgctgatccggaactgtacgaggaaatgaagaaatacggccgccgcaacatcgcgtgtctgaccatcgctcctactggaacaaccagtctgatgactcaaacgacttcaggaatcgaaccggtattcatgcctgtatacaagcgccgtcgtaaagtaaatccgaatgatgccaatgtacacattgacttcgtagacgaaacaggagatgcttttgaagagtacattgtattccatcacaagttcctcacctggatgaaagtcaacggatacgatccggacaagcactatacccaagaagaaatagacgagctggttgccaaatctccttattataaagcaacatcaaacgatgtagactggctgatgaaggtcaagatgcagggacgtattcagaaatgggtagaccattctatcagcgttaccatcaacttgccgaattcagtcgacgaagaactggtaaaccgcctgtatgtagaagcatggcgttcgggatgtaaaggctgcactgtataccgcgacggttcacgcgcaggagtgcttatctctacacagaagaaaaaagatgctccgaaagaagaagactgccactgcaaaccgcctcagataacggaagtacgtccacgtgtactggaagcagatgttgtccgtttccagaacaacaaagaaaaatgggtagctttcgtcggactgctggacggtcatccttatgagatattcaccggtttgcaagacgacgaagaaggtatcgtactgccaaaatccgttacttcgggacgtatcatcaagagttacgacgaagacggaaccaagcactacgacttccagttcgagaacaagcgaggctacaagatgacaatcgaaggtctgtctgaaaagttcaacaaggaatactggaactatgccaaactgatttcaggcgtgttacgttaccgtatgcctatcgaacaggttatcaagctggttagctctttgcagctcgacagtgaaaacatcaatacatggaagaacggcgtacagcgtgcactgaagaaatatgtacaagacggaaccgaagccaaaggaatgaaatgtcctaactgtggacacgaaaccttggtttatcaggagggctgtctgatctgtaagacttgcggaacatctcgttgcggataatcttatgaaaccgacagcaaacatgtatatccacctgaaaggcctgaagctgtatgcttatcacggtgtgcttcctcaggaaaatcaggtgggtgcagaatacaccatcgacttgcgcttgaagacagacttcacacaagcggcggaaaccgaccggctggaaggtaccgtcaactatgcggaagtcttcaacgctgtgaaaaaggagatggagattccttcccaactgctggaacatgtggcctggagaatagccaggaggctgctggacgattttccaacaatcagcgaagttgatatcgctctttacaagcagaatcctccgatgggagctgattgctctctggtgggcgtagaagccacttacttcagataagaaaaacaagctccggatggtgaaagtaatcgtatcggttaccagtcacccatccggagcttgtttcatttatcgatatatcacgaagtattaattgtatgtcgtcagttctcaccatacaacttaaacaatcgatttttcctaaagcctgcttaccatctatcggaaagcaaggtcatttcatctatttgtacagacgattcagaaaaaacctctgcatgttttcggaaaatttgtacaaacaaaaattttttttgtacaaaaaataaccataatacgagtaccttctttgggaaatgacaccacaccccaaagaaacttcgcggacatctcttataacaatatccgagaagtattcataaccaactacatacctcttgttatctcataatcctttccagcctccgtcgccaaatcgtactcatatactttggggatgataggatactgcggattgatttcctcagacaccagtggttcctttattttagcttgtacgaacaatgggttaggattctttcccgatgcaggtttcagcccttcccctttcaacggcacatacgaacgtagtcgtaaattacctcccaagcgagagtgaattttggcagcactcagctgagcaccatcccagtccatgtcgacaacaaagcctccacgggcaaccagccctttcacacttccctcagcccatgcatccggcagtgcaggaagcaagtgcacggctccatcgtgactctgcaacaacatttccgccactccagctgtaaaaccgaagtttccatctatttggaaaggagggtgtgcatcaaacagattaggataggtccgtccttccggatatttatccttcacctcatcgttgggaagcaataccaataaattagaaatcatcttatacgcatggttaccatcgagcagacgtgcccataaattaattttccatccgatagaccatcccgtagccttgtctccacgctgcaacaacgtatttttaacagcctgaaaaagcaacggatgagtgaacggagaaatctgattgctggggaacaagccataagcatgtgatacatgccgatgcccgtctttaggatcatccaagtcctccagccattcctgcaactgattatatcttcctatctgcatcggagccatctcggaaagcaatgtcctcaacgaatctctgtaggctgccggatagcctagaatttcagaagccgccagcgtatgactcaatacatcaaaaataatctggttatccatggtacaacccgaaacgatggtagaggcttttttcgtattttctccattcggaccatgttcgggagacatcgaaggtgccgttaccttccatccatattcaggatgaggtatcatatagtccagaaagaaatcggctgcccctttcatggccggataagattgtttcaagaaatctttatcgccggtgtataaataatgttcccacaaatgagtagtcaaccaggcaccacctaccggccatgtaccatagaaagccttatctaccggaccggtaatgcgccaaatatccgtattatgatgagccacccagccatcgcagccatacattgtacgcgctgtttcacgtccggtcacagccaaatcctgtatcaagtgaaacaaaggttcatgagtttccgacagattggtaacctctgccggccagtaattcatctcggtattgatattgattgtatactttccatcccacggagcattcagctgataattccaaataccttgcaaattggcaggctgtcctcctggttgtgaagaagaaatcaacagataacgaccatactgaaacattagtgcagccagttcaggatcatttccgcggctgaaaccggcaatacgcttgatggtttcctgtctggctgctttccgatctccccctttcagagaaagcaaaacccgattaaactgcgactgataatagtctgtatgtgctttcaatgctgaaggatagtcccgtttcatggcaccagccagcaaagccgaagcctttttactttcatttcctgtcacatcgtgataattgataaaattggttgcagcagctatatacaaggtagccgatgtagcctgctccacagaaatagcctcatccgtcagagaaactttaccaccttcggcaaccacctgactctgggtttcaacttctatcactcctttcaccccttcatgatcgcctcctttgccgcgaagaatcagctttttcccttgttttctcaccttactttgcaacggagaagtatatccgaccttaaagttcagcttacccggctggtcggcagtgaaacggacaataatcacacggtcgggaaaagaggcaaacacctcacgctgaaaattcaccccgtccacctgataacgagtcgttgctacggcccgctccaaatcgaggtcacgatagtaatttatcgctttttcatgtcccggtgtttcaatcaccaaactcccgattgtctgataaggcataccgttccgccccgtataaaatgtctggtcaatcaagttctgtgcgtccattgtctttcctgcaaaaatcagcttgcgtacctcattcagactctccaacgccttcggattgtcgtttctgtacggtccgcctccccaaagcgtttcttcattcaactgcaattcctcgtgcgaagttcctccatataccattgcccccatcgaagagtttcctacgggcagtgcctctacccacgtttttgccggttgctgataccacagcttcaaattttgtgcttgtaccggaaacatgatgcagatacatgttcctactaataacaaatgttttttcatatagatttagttattgtatttaagacgataaaggtagttaaaagattactggtatacaaccatttaaatatgttttacgtcacaaaagcaagcaaataaaaactacctggatcttcgtttttcaccaacgcaaatccaggtagttactattctgaaaaccaaataattatcaagagccaatcttatcggtctgttataggaacatatcctacctcttcaagcacattcttgtatgccggacgaatgatacgacgtccctcgaaattcaattcctcgatgcggtgtgccgtccatcctacgatacgtgccatggcaaagagcggcgtatatatctccatcggaagtcccatcatctcgtagataaaacccgaatagaaatcgacgttcgagcaaacctgtttctttgtacccttcactttcttgaagcattcgatggcacgctgctccagcagttcgaggaaagcgaattctttttcgcatcccttctcggcaaccagttcactcgccagctccttcagaagtacagcacgagggtcagaaatggtataaacagcatgtccgataccataaatcagcccacttccgtcgtatgcctccttacgtaacatacgcatcaggtacgtatctatttcatctacgttcgtccagtcggagataacctccttcaggtgatggaacatcttgacaacttgtatattcgcacctccatgcaaaggacctttcaacgagccgatgcctgccgcaatactggagtaagtatccgtacgggtagagctggtaacacgcaccgtaaaggttgagttgttaccaccaccgtgttctgcctgaagtaccaacagcaaatcgagcatacgagcctccaaaggtgtatagtctctctttatcatgtaaaggaagttctcggctatcgacaggttttcgtgcggatgacggatatgaagcgaacgtccatgaatactatgacgatagatattgtacgcataagcaataatggtagggaacttcgatatcagttcgatagactgacgcatcaggttatcgcgtgaaatatcgtccggattgggatcgaaagtatacatctcgagcacacttcgtgccagaatattcatgatgttctgtccctccaggtcgatgatattcatggttgtcttcttgtcgagcggcatattgtcgtttatcagctctttgaaagcatctagttgctcgctgtcgggcagttctcccgaaagcaacaagtaagcaacctcctcgaagccgaaacgtttttctctcagcagggcgtgggcaatgtcgtccagatcatatcctctgtaaaacagttttccgggaataggtttcagtccatcttccgtacgttcatatcccaccacattaccaatcttggtcagtcctacgagaacacccgttccgtcttcattacgcaatccgcgcttcacgttgtatttcgtgaaaagctcattgtctatccggcatgcctgcttggcacactccgaaagtttatatacgatatattcttttttcatgtcgatacgttcttttgattacaatgattcaaccacacgctgtccgaattccttcgtacccaaagcttttccgttgggcataaagcgtgccagatcggccgttgcctctcctgcttcaaacaactgttccagagcattggtaatgagcgcagctgcttctttccatcccaaatactccagcatcatgacagacgacagcaacaacgagcagggattcaccacattctttccggcaatatcgggtgccgtgccgtgagtagcttcgaaaatggcatgtcccgtcaggtaattgatattggctcccggagcgattccgatgccacctaccatggcagccagctgatcggatatataatctccgttcaggttcagggtggcgataaccgaatattcttccggaatgagtaacgtattctgcaagaaagcatcggcaatgcaatccttgatgaaaacttttcctgtattcatcgcatcggccaatgcagctttcgcagattcttcacctaaatccttctttaactgattgtactggttcatcgtaaacgtacggtcggcaaactccgtttctgctacttcgtacccccagcgcttgaaacctccttcggtaaatttcatgatgtttcccttgtgcaccagtgtaaccgaaggcaatttatgctgcaacgcatacaaaatagctgcacgtaccagacgtttggttccttctaccgatacaggctttaccccgaacgatgacgtttcggggaaacgtactttctttacacccatttcatcgcgcagaaaagcataaaacttcttcgcttcgggagtaccctgttcccattcgatgccggcataaatatcttctgtattctcacggaaaatatgcatatctactttttccggttccttgacgggagaaacgactccacgaaaccagcgtaccggacgcaggcagacatacaaatctagcgtctgacgcaaagccacattcagcgaacggattcctccccctactggagttgtcagaggccccttgatgcctatcaaatattcacggaaagcatccatcgtagcttccggcaaccattcaccggtctgttcgaatgctttgccacctgccagcacttctttccattcgatggagcgtttaccgctgtaagccagcttaacagcttcgtttacaatctgctgacacaccggagttatctccgctcccactccatcaccttctataaaaggaactgttacacagtcgggcacaatcagccgaccgtcttgcatatagaccttactcataatctttttattgttttttgaatgtattcagggcacaccctactttaaaccaacctatctgcatttcattgtatgtatgcgatgccaggaatgaatcttctgttccgtcttcatgtttcacgattacctgcaacggttttcccggagcaaaaccatccagtcccacaaccgaaaggagatcgtgttcctgtatcttgttgtaatcgtctttatttgtaaaggtaagcgccagcataccttgctttttcaggtttgtttcgtgaatgcgggcaaaactcttggctagaattacgcgcacattcaggaagcgaggttccatggctgcatgttcacggctcgaaccttctccatagttttcctctgccaccacgatagaaggaatgccttttgccttatattgctttgccacactcgaaacggcttcatactcgcccgtcagtctgttccacacactattggtcttgccattgaatgcgtttacagctcccatcagcatgttgtcggaaatgttttcaagatgcccacggaaacggagccacggtcctgccattgagatatgatcggtcgtacatttaccctgtgtttttatcaacaacggcatatctgtcagatcctttccatcccacgccgcaaaaggagccagcttctgtaagcgcttcgaatcgggagcaattgatacttctatatcttttccgtcggcagccggagctacatatccgttgtcgtctaccgtaaatcccttacccggcagcgtttctcctacaggtgcatccagtctaacctgctcacctctttcattggtcagtgagtcggtcagcggattgaagcacaaatcacctgctatagccagtgccatagccagttccggcgaagcgacaaacgcatgcgtattcgggttcccgtcggcacgcttggcaaagtttcggttaaacgaagtcacgatagagttggcacgcagcggatcatccgtcacacgcttccactgtccgatacacggaccacaggcgttggtcataatcacaccacctaccgcctcgaagtcggctatcataccgtcacgtttcgccgtacaataaatctgttccgaacccgggttgatgattaactgagcagccattttcagtcctttagccttcacctgacgcgccaatgaagcagcacggctcaaatcctgatacgaagagttcgtacacgagccaatcagtcccacttccatgcgctgcggataaccgtttgcacgcaccttttccgcaaattccgagatcggacatgccgcatcgggcgtaaacggaccattgatatacggttccaacgtagacaaatcgatgtcgataattctatcgtaataggcctccggatgagcttctacttccgcatctgccttcagatacagcgcatttcccgaagccatcagtgccacttccttacgtcctgtagcacaaagatatttttccatttcctcgtcataggggaaaatagaggtcgtagctcctacttcggcacccatattacagatagtagcctttcctgtagcagacagagaagctgttccttctccaaaatattctataatagcattggtagcaccctttaccgtaagtatacctgccaacttcaagatgacatctttcggcgaagcccagccgttgagtttacccgtcagacgtactccgatgagcttcggcatcttcaattcccactccataccggtcatcacgtctaccgcatcggcacctcctactccgatggcaatcattcccagaccaccagcattgggagtatgcgaatcggttccaacaatcattcctcccgggaaggcatagttttccaacacaacctggtgaatgatacctgctcccggtttccaaaagccgatatgatatttcgaagcaacacttttcaagaaatcgtatacttccttatttgtttctttggctaccggcaagtcttcctttaccccccgatatgcctgaatcaagtgatcgcaatgtaccgtagccggaaccgcagaacaatccttgcctgagttcataaactgcaacaatgccatttgtgccgtagcatcttgcatggctactctgtccggacgaaagtttacataatcctctccacgacgaaaagcagcggcagtacccgcatcatacaagtgggcatacaatatcttctccgccaaagtcatggccttacctaatttcacacgtgcagcatctacatgtactgcatacgacgcataaaagcgtttcagcatctcaatgtcgtaaaccattctgtcttcctttctattttaccttattttttgtgtcacaaacatatagaaaatattttcaactatcaacaaaatcgcaacaaattcattcattttgacagaaaatcacctaacattgcataattataacataaagaaaacgactccagccaaaaactttccgatcttcttacaatcacctttccgatgcaagaaccccacatcctgaaaaaataaatacacgaacacacagacttcgtagataatcactatctttgcccataaatcatggtgatatattaatatgagtaaactgaaaaaaacatgggagtatatccgtcagcataaatatctaattactataattgtttttttgctgatcatcggagtattggacgaagagaatagtctgatacaacgtttttcgcactggcgcgagatccgtacactgaaaacggagatacaacattaccgcaagcagtacgaaagagatagccgtgagctgaaagagctgacttccaatccggaggaactggaaaaggtagcccgtgagaagtatctgatgaagaaagaaaacgaggatatttatatttttgaagaagatttgaaaaagaacaaggatgaataaatactattctgtcatagctaccgtaggggcggtagttttattgctgggagcagcgttacagataaccaaactggtgtgggctccgtatttctatttaataggtgccattatgtttgcttatgtacaggtcatgagcggttacgaaggcaaaaatatcgttatccgtcgcctgcgtcgccagcaaattatcggagccattctgctggtggtagccggagtgatgatgatactctggaaacgaaacgaatgggttgcatgtctgacaattgctgccgttctggaactgtatacagctttccgtatacctcaggaagaagaaaaagaaaagaaacattgatatatcccaaaaaacgccgggacaaatcatccaattcgtcccggcgttttcttttatttctcgccacattttttatttcatcaccatgttttttcagaaacatgtatcgtgtcagcgtacgatggtcatttcgtctatcagatgcttggcgccggcatatttatcgatgacaaacaatacatagcgaatatcgacacaggctgcacgctgcaactgcggattataggcaatatcgccagtcagaccttcatagttgcggtcgaagccgacacctatcagctcaccttttgcattgaagactggagaaccagaattaccacccgtgttgtcggttgccgttacaaagcatacaggcatccgtccgtcgggcatggcatacggtccgaaatccttcttctcatacaattccttcaacttgggagaaaccacgaactccggattgtctggatcttctttttccatgactcccttcaaggtggtataatacaaatactccttaccgtcggcaggttcgtacgaaccaatctttccgtaagtcagtcgcaaggtagagtttgcgtccggataaatggccttaccttccttctgcttcagagccaacataccggcaacccatgtcttgtgcgcacggttataggcattcgtttctgctttcatagcctcatccatagccttgtaaccttctttcaccgacttggcatattgcaccatcgggtcattcttcagttttccggcattaggatttttcaggaaagcagccagagcctcaggactccggaagattgacttgtcaaagcaagcgtcgacaaaagcatcggtattgccaccgaatttgtcatctatcagcttgaagatgctgatacgttgtccggcaggaatcagttgtgcgtacagagcaatcagttgcttggaaaccttgcggtcgactgccgtactataatctttattaaagaatttctttccctgttcgtctaacgcagcaacagctgcttttatgccttttgggtcattcttctccaacgaagcaagcaacttatccgtgtcaggaatcttcgaaaattcggtacccagcatcaacgcttcatagatagcctgttgatgatataccgcatcgtgacgtttggcaacaatctgcttgatcgtttcgtatgcctgacgatagctgtcattacccgtttcttcgccgaaagccagcagacgtttctgttcatctttcttgcggtcgagtactttcagcgatacaagtccttcattcatgccgatagcattcttccagtaattggcagaagaagcatacttggctgcatactggatacgtgtcttggcatcctttgccatttcctcacccagcactcgcagacggactccgcgcacggtatcacgcataaagttggtagtctgcatacgttcctccacctcatcgctgatcatgtaacgccagttacgtccgggaaatcccattacaaaagtaaaatcgccttcctttatgccacccatgttgatggtaagatgtttctttaccttcagcggaacattatcggctgcatagttggcaggctttccgtccttcgacgcataaatgcggaagatagaaaaatcgccgcaatgacgcggccacatccagttatccgtatcggctccgaactttccgatagaagaaggaggagcacccaccatacgaatatctttatacaccgttttgacaaacaggtaatacttgttggctccgtagaacggcttcagttcgagaacggtaaaatcgtctgtcttgatattttctttcttggcaaaacgctcggcaaccgtcgacaagtacgaaggagaaaggtaattcaatccttccggatcatcatcctttttcaattgttcctgcacatagtccgtcacatcgagaatacggtcgataaacgtaatggtcagtccctcacaaggaagttcttccgcacggctcatcgcccagaagccatcggtcagataatcgtgttccaccgaactgtgctgctggatatactgatacccacagtgatgattggtcagcaccagtccttcggaagaaacaacctctccggtacatccacccccaaaatgcacaactgcatctttcaggctgatactgtcgggacaatacaccttgtcgatgctgatatccagacccagatcctgcatgacggcagcattctgtttcttcagatcggtcagcatccacatgccctcgtcggcatatccggcgagagagcatgcggcaagcatggaaaataataaggttttcttcattattcaacgatagtcatttcgtcgatcaggttcttgcaaccacccagtttctcgacgatgaataatacataacgaatatctacggcaatacaacgctggaggttgttgtcgaagttgatgtcacctgaaagtgattcccagtttccgtcgaaagcagcaccaatcagttcgccgttgccgttcagcaccggagagcccgagttaccgccagtaatatcgttggtagtcaggaaacaagtcggcatctcaccgttaggcaatgcatagcggccgaagttcttcgtagcatacaactctttcagtttagcaggaacaacaaattccggattgttcggatcttccttttccattactcccttcagggttgtatagtatttgtagtgaataccatccttcggatcgtacgatttcacattaccataagtcagacggattgtaaagttagcatccggagctttcggagtcggagcatacatttcgcacaaaccgcgtacgtaagtcttgtgcaacaagtcgatgtcaccgcttacagcactgtatttttctctcaacttctgcgccatgtcgttcttgcttgacgaatactggatagccaggtcattgtcgatagcctctaccgtaggattgctgatgaacgcattgaagttcttttcattagagaagatactgttatcgtacaaagcatcgatataagcattgtaatcacctttgaacttcgtctggatagtctgatagaatgcaggcagtgcgtcggccggaacactctttgcgtacaacggaatcagcaccttggcaaccttgcgatctacttcgtggtcgtagtccttattgtggacatctgcgtaagcttccttcaggctgctgatagcattttcaatatctttctttttgtttttctccagtgccgtcttcaagttgttgaacaacatgtaagttgcaccaaactcgataccacttctgaacgtttcgctgaagtaaaccatctctttcgtaatcggagtagccttctgaacatactcgtcaatctggctcaccaccttggcatagtcggcattgttctgtgctttggcaaactgagcaaacttagcttcctgttcagcctttgcttcgagcaccttattatcgataatagccttgttcataccgatagagtttttccaatagttgctggaagaagcaaacttgcttgcgtactggatacgtaccttgtcgctagcagccatctccttacgcaacacgttctggcgagcttcacgtacttcgatacgaggaatattcgtaccttccatacgcatcaccacttcgctccgggtcaggtaacggctggtacttcccgggaatcccataatcatggcataatcgccttcctgcaagcccttcagcgagatagccaggtgcttcttcactttcagaggcacattgtcggcactatattcagccggattaccatccttgtcggcataaatacggaacattgagaagtcgcatgtatgacgcggccacatccagttgtcagtttccccaccgaacttaccgattgacgaaggaggagcagcaaccatacgtacgtcgctgtatgtcttaatgaagaacagataaaatctgttaccttcgtagaaaggcagcgcttcggcagaaattcccggcttacctttcaagtcactctttttcaattcttcagaagcaagtttatccagatactctgcaccgaaagaatttatttcagttaccttaccttccttaatatcctgattaaccttatcggtcacatccacgatacgctctacaaacttaaaagtcagtcccggagtaggaagttcttcggcacgacttttagcccagaaaccgtcagtcagataatcatgttctaccgagctatgttgttggattgcatcataaccacaatgatgattagtcagaataagtccgtccggagagataatttcgcctgtacatccacgtccaaaaattcccacagcgtctttcagtgtcacactgttcgggctataaatatcggcaatatccattttcaagccttgtgctttcattcggtcggcaaggttctgctccttcatcatctgaagaagccacattccttcgtcggctttcaccggtgaaaaggctgcacaaatcagtgcaaatgctaatactttgagttttttcattgttgtgatatttaaataaattataattgaatctatcccattatttgcaaatagtcagcaaagataaataaaaatacgtttaacgtatcttaaatcagtaatattcctctatttagtttaaattttgataatttattttcacgacatttctaaacattatacctttgttgcagaatttctaaaggcttattgcatgtatagattttatttttttctcttttgtgccatcatctgcgcttcatgcggaaagaaatataagatagagggtatttcttctgtatcaaaactggatggaaaaatgctttttatcaaggtaccttctggcgacaagctggtaaacatcgactcggccgaggtggtacacggaatcttcaaaatgaaagggaaagtagactctacggttatcgcctcactttacatggacgacgattgtatcatgccggttgtgatagaagaaggaaatatcaatatcaatatcgacaagtcgggcttttccatcaaaggaactccactgaatgatagcttcaacgaatttatcgtgaaaaagacttcactagaagaccgtgcctatgaggtggaaagaatggaaagccgtatgattatggacggaaaagatccgaaattcattcaggaagaaatggagaaacagcgtagtgcactgggtaaggacatggacgaacttgccaaatctttcatcgaagaaaactacgacaatgtactcggagcaggtgtctttctgatgttatgcaacggcttcccttatccggtactcacacctgtcatggaagaaatcgtaaacaacgctcccgaatcgttcaagaacaatccgatgatcaaggaatatgtttcggtagcacgcagcaacatggataagttgcaggctgtgcagtaacttcttcaggaaataattacagcagatcctttagaaaaataatgacaacatactcagaacttgataaggtttaagaggccgtctcaaaatagaattgcaaaagtaaaaatcttatagattaaaacttagaagtaaaaaaatctcctactttagtctttgttttcttcaattacaggacaaaagtaggagatttttttacgttgtaacttatagattataaataagcctatctcagctttttattttgatatagcctcttttgtacaaattcctaaaatatttcgataaaggccggcagatttcaagaaataatgcagctcattttcttcagtaaacggcatattttaccccctttacctgcttgtttcgcttcatcggaggctttccgaacacggaacaaagagataaagggggtaaaacgtttactggtcaggattctcgatcttgcccttatatttttcgggaaggtctttttcgatggccttgtatgattctgtcatcagcatgtggaggttctcctcacctttcttacccagcggataaatcggttcgtggatggtcagcttcatcggatgccagtgaagcagcttacccgtacggggaagaatatcgaaagacccgtctatcgtcaacggaacgacaggcaactgaagctggtcggcaagcaggaaggcacctttcttgaagtttgccatgtgaccggtaaaggtacgtgctccttcaggaaatacgaccaatgaagttcctccttgaagtaccttttctgcaccctttatggtttcatagacttttcgtgggctggacttgtcgacaaagatgaagcctgccgactcgcatgccttgccgacaaacggaattttacgaaggcttttcttcatcatccatttaaagttacgtcccagaaagccgtataccagaaaaatatcgaatgatccctgatgattggccacgaatacatacgatgttttcttgtccaaatgttcgtgccctttcactttaaccggaagcaaaaacaggaaacaagtaagctgtgaccacagctttccgggataatacccccagaaatgaccgtcccccagccagcagcccagcatggtagtcagggcagtcagtatggttgctaccagaaagatgggcaacccaatgcagatttgatagataatgtataaaaatctcattgcttattatagtttataaattattatttcttgcgtaaagtaatgaccgttatctccggccatgctcccagcctcataggaaacaacacataccccagtccgatattgacatagagtccgcgaccgtcttgcagatacagacctctgtattccggataaataaagcgggaaaaagaaaactcgaataaattgacctgcatatcgtgcgtatgtcctgccagcatcaactggatatcggtatccggcagtacgcttctacgccagtgagtgggatcgtgactcagcagtaccttaaacataccttccgtaccttgctgtgcccgaggcaaatctccccggtcgggaaaaggaggccggccgctgttttctactccgatcaatgcaatcgaatcgtttccgcggcagataatgcgatggtcgttcatcagcatcttccagcccatctgttcttccctcattaccagcgtatcaatatttgccagccgttccgcctcgctgttccagcgtacgtaagtaccgtagtcgtgattacccaatacagaaaacacaccgtctttggtatgcaacttcgaaaagactggcataaactccttcatctcgtcggcacgactgtttaccagatcgcccgtaaacacggccagatcgggatgctgagcgttgcaaagagcaatagcccgctgcaaggcctccgcatttcctttccagcttccggaatggatatcggacaactgaagtatccggtaaccgtcgaacgcagcgggaagatcgggagaagagaaagtaacctgctttacctgaaagaactccttaccccagatagcaccaaaaagaacataacctaatgtagcaactgccacaacggtagatacgctcttgtgatacaacggcacgcggacaagccggtgcaaagccctcagcaccacatcacataatacaaatatgagtttcggtacggcaaaacagagtgtgataatcaggtaaacgccaaaagcgtcgtgcagggaatcatgtgcagcaacaaagacgaccaatgccagcaacagcagaattgtcggcaaccaatatagcttcttcatccacacctgcgccgcctgcttgatatataccttatatatataccagtcgggcaacaacagcaataggataaaaaacagcgaaactcttaccagtatcataacatctttattgttgcaggttagcgactaaatattttctgattttatctacttcacatccacgtcgggcagcataatcggcaagctgttcctcgtctatcttccccaccgagaaataacgtgaagccggatgcgcaaacatcaatccacataccgatgcatggggctgcatcatgccgttttccgtcaatcggatgccgatgcgtttcatgtcgagcagctcgtccagcaggaaactgacagaaatatcgggaagcgacggataacctaccgccggacgtatgccctgataatcttcattcagcagttgcttcatggtcaggtgctcgtctttggcatacccccatacgctcttccgaatggtttcatgcactttttcggccgcagcttccgccaggcgctcgcccaatgtctttatcagcatgtattgataatcgtcgccttcgaattctttttccatatcctcatcgatggttgttgcaaaggctcccaccgtatcagttattcccgaagacagaggacgcacgaaatcgctcagacacaagaatggatcgtccggccgaaccctcgtctgctgcctcagcaacgggaaacgggttccttccagtatcaggttgtcgccatcggcattggcgttcatcagccggtaaatggcatataccttataacgtccgtctatgctgttcagcatgcggttggcctccttatggagctgcatggcctgtgctgccttggcacaatcttcggtaggaaacgaagccagccagcttgcccgacaagcatcgcagccgtgaatatcggctatagctgcaaaacggggctgaaatccccacgcatgaaaaaaataaatccagttgatatattctgccagatcgtgtatctcgtatgtaactgttgtaatgtctgtctgcattttctatcggttaaagacaagtgcttccccacggtgctgagtgtctaccttgccatcgctatatactaatgttccgtttacaaatgttttctctactttcgcatggaaatgttttccttccatagggctccatccgcatttactcaagacacaatccttcgtcacttcccattcactgtctggattgaccagcaccaagtcggctttatagcccggacggatatagcctcgtctgtctatctggaaaagctctgcaggcgcatgacacatcttctgtacaagctgttctaccgtcaaaactccttcccgaaccagttccatgatacttaccagcgagaattgcaggctcggcataccagaaacagctttcagtgctcctccttgtttttcagtaagcagatgaggtgcatggtctgtaccaatgacatctatcagattcgtggaaagggccttgcgaagcatatcgcggtcatttcgggtcttgatactcggattacatttaatacgtgcgcccaatgtcttgtaatcctcatcgcagaacatcagatgggatacacaagcttcggaagtaatacgcttttcggctatcggcttgtcctcgaacaaagccagctcgcgtgccgtactcacatgaaggatatgcaaacgtgcccctgtttctttggcaagctgtactgccagagaggacgaatgccagcaggcttcctcgctacggatgcgagggtggaaggaaatatctacatcttcttcaccatatttcgacttaaccagttcggtattccagcgaataatcgtctggtcttcgcagtgtgcagctatcagcatacctgcttcggcaaagattttacgtaatgactcgatgcggtctaccagcatatttccggtactggctcccataaaaagcttcactccgcacacatgagtcttgtcgagctcatgcagcaaatctacattgttgttcgttgccccgaagtaaaacgaataattcacgatgcacttgttggctgcgtcggcaaatttattgtcgagtgcctccagcgtagtcgtctgcggattgcagttcggcatatccatgaacgaggttactcctcccgctgcggcagccgtcgtttcgctcagcatatcagctttgtgcgtcagtcccggatcacgaaaatgtacatgatcatctataactcccggaataaggtaacatccatgagcatcgatttcgatgtcgcacaaaacagagggtcgcgtttctccttgcaaaacttcactgatcgtatcgccttcgatcacaacagaaccggcaaactttaatccttcgtttactattgttgcgttataaatccacgtacgtttcatttttatttattttttggataacttttaaaccaactatcccacttcaactgaatcactccaaacacggcttctccaaatatgctgctgttcatcttcgaggttcccagctcacgattgacaaaaataaccggtacttccacaatcttgaaaccacacttataagccgtaaacttcatttctatctgaaaagcgtatcccttgaaacgaatattgtccagcggaatggtctccagtaccttgcgcttatagcacttgaaccctgccgtggtatcgtgaacagggataccagttacaaagcgtacatactttgaagcaaaatatgacatcagcacacgtcccataggccagttcacaacgttcactccgctgacataacgtgacccgattgccacgtcggctccatcgtcatggcaagccttatacaaacggggaaggtcgttgggattatggctgaagtcggcatccatctcgaatatgtaatcgtatttatgttcaatagcccacttgaagcctgtaatataggctgttcccagtcctaattttccttttctttctatcataaacagccgttcgggaaactcggtctgcaaccggcgtacaatgtcggctgtaccgtcgggcgaattatcttcaataaccagaatatgaaaacatttctccaggccaaacactgcacgaattatattttcgatattttccttttcgttgtaagtaggaataataacgatactgtcacttgtctgcataataatctatattttaggcaaagataaatatatttcaggtcgagcccatgagaaaacagagattttatgtacttttgtaattccgaatttgaaaacaattaaccacttatatcggcgtatggagaattatatcgtatcggcacgtaaatatcgtcccgctacattcgataccgttgtagggcagcgtgccctgactactaccctgaaaaatgcgatagccaatcagaaactggcacatgcctatctgttttgcggaccgcgaggggtggggaaaacaacgtgtgcacgaatttttgccaagaccatcaactgcctgcatcctacagccgacggagaggcgtgcaacgaatgtgaatcgtgccgcgctttcaacgaacagcgttcatataatattcatgaactggatgccgcatcgaacaactcggtggaggatatacgttctctgattgagcaagttcgtatcccgccacaaatcggaaaatataaagtatacatcatcgatgaggtgcacatgctttctcaggctgcattcaatgccttcctgaaaacgctggaagaaccgcctcatcacgccatcttcattcttgctacaaccgaaaagcataagattcttcctaccattttgagccgttgccagatatacgacttcaatcgtatcagtgtaagcgacacggtagaacatctggagaacgtggcaagaaaggaacatatcgaagccgaaccggaagcactgaacgtgattgcacaaaaggctgatggaggtatgcgtgacgccttgtctattttcgaccaggtggtaagctttaccaacggacatatcacttaccaaagtgtaatagagaacctgaatgtactggactatgaatattatttcagactgacagatgcttttctggaaaaccgaatctctgactgcctgcttacattcaacgaggtattgaaaaaaggtttcgacgggaatcacttcattacgggactgacttcgcatttccgcgacttgctggtgagtcgtgatccggcgaccttgcaactgctggaagtgggtgcctccatacgcgaccgctatcaggcacaggcacagaaatgcactcctcagtttctgtacaaggcaatgaagctgtgcaatgattgtgatctgaattatcgtgccagcaagaacaagcgtttgctagtggaactgactttaattcagttggcacagctgaccaccgacaacgatgttcccggtggggggcaaagccctgccaagcaatcattaaaaccagcattcaatcaggcgcaggcaagccagacagcacaagcaagcgctaatcaggcatatccgcaggcaacacatgaaacgaccggtaattatcaagcaacgcaacaacaaccagccggacaaccagctgctagtaaaccttctgttcagcaaacgataactgccgttcagccgacaccgcctgccggacattccaatccgctccctaaagcaagtacggaaaagaaaattccggtcatgaaagcgggaaactttggcatatctatccggaaacaacctgtgcagcaatcatctgtcgccaacaataatcatccgacgaatgccaacccagcatcacaacaggtagagcaaacgtatgaagattatatcttcaacgaaaaagatctgaattattactggcgtgaatttgcgacacagctccctaaggaggaagcggccaactctgcccgtatgatgaacatgcagcctcatctgctgaaagaccagacaacatttgaaattgctgtcgacaatgatatggtacagaagtatatgacgcaactggctccacagatagaacagcacttgcgtcggcaactgcataaccggaagataaaaatgacggtccgtatcagtgcagccaacgaaaacgtccgtgcctacagtcatgtagaacgcttccagatgatgagcaaaaagaaccctagcctgctgaagctgaaggaaacattcggactggaattatcttaaaaataaagccatcaagatttctggctttttgtctgatgtgatatttctgagctaaatgaaaacggaggagtcatttcaggacaaaatttaataaaaagacaaggtaatcgaactaaaaagttttatatacaacaaaaaggccacttcatctttccgatttgaagtagccttttttcatagagaaacagagatgttatttagaatttaaatactctttagcaaagacatccctctttcaatcatcattctttatttaaagatcgtggttttgcatacggtattctgccagtttttcgtatttcgtacccggacgtccataattacaatacggataaatggaaattcccccgcgaggagtaaagattccggttacttcaatgtacttgggatccatcagtttaatcaggtctttcatgataatgtttacacaatcttcatgaaaatcaccatgatttcgaaaactgaacaggtatagtttcagactcttactttctaccatcttgacatcgggaagataactgatgcgaatctctgcgaaatccggctgtccggtaataggacaaagactggtaaattccggacaattgaatcgtacccaatagtcattttcaggatgcttgtttacaaatgcttccaatacttcaggagcatagtcctgtttataagtggtagtccttcctaatattgtcaattcatcttttctttccatatattacaatctaatatgttcacaaaacattgctactcacaaaagcccaccagcgggcttgcaagaaacaattttattttattttttcaagaaactcatctcaggcattataaggaagtatccccattatcaatcataaaacccgacagcatcttatttattcttgcttgctaagtacttttcaagcccttctctacgcaaagtacatgccggacaatgtccgcaaccgtcacccggaataccattgtaacaagtcagtgtttcatgacgcaccaagtcgagtactcccagttcatctgccagagcccaggtctgtgccttatcaatccacatcaaaggcgtatgaatcacaaactgttcttccatagcaagattcagcgttacgttcagtgatttgataaaagtatcacgacaatcgggatatccgctgaaatcggtctgagaaactcctgtcaccagatgataaatgccacgctcacgggcataaaccgctgcaatgctcaagaagaaaagattccgaccgggaacaaatgtattcgggaaggttccttccggcttcttctcatccatatggatagaagtatcagtcagtgaatttttgcccagatgtccgatgaaagaaacatccatcgcgtcaaattctacttctgccttacgagctatttcacgagccagctccacctcttttacatgcttctgcccgtatataaaactcagtgcgtatacttttttaaaatgtttttttccccagaaaaggcaagtggtagagtcttgtccgccactaaataccacaagtgcagcttcgttattcatcttaaatctcttttattttcaatacattataagaaatgtgttcatcgtatacatcactatcgtctacacgcttgatgtacttcacgacacggatagtaacaggcaggatgattacttcgtacaaggttttaagaactacctgcaccaacatcatcttaccaagttctgatacaggcatcaagccaccgaatgccagcgggaaaaagatcagcgaatcggcactctctccaaaaaccgtcgagagaatggcacgtgcagaaaagttctttccatgtgaagcaaccttcatgcgactcatgacgtatgcattgataaacgaacctaccaggaatgcaagaaggctggccacagcaatacgaggtgccatgccaaagacgaagttaaatccttcctcaccttcccagaaaggggcagccggcaaagctacggcaatctgtcccattgccacaaccatgaaattcataaggaaacccatccagatgataagacgtgccttacgaaatccccatacttcggctatgcagtcgttaataatgtaagaaattggaaatacaatcagtccggcagttacagagatcggacccacttgaactactttggtttctaaaaggttggctgctaccaggcagacacaaaacacaatacccaaaaccataaaaggtactgatacgagattttcttttttcatcgctcctgttttttacgtggtgttctagaatacacggccgttattcacggcatcacatgttaatgtcctcttttttaattcggcgcaaaggtactaactttttgccaaattacaaataaacgcttatatttgtgcatactaaattcatcctgacatgacaaagaataacttgctcagtgaaaagctgaattatataggagaaagtgaaacccccactcatttacacttatgcagttacaatgctgaaggaactcaggtctgccggggaaacttgcaagaagtcattcctcagttgaaaaccgactgtatcaactggatacaggtacacggcttgcaaaatacagaaacaatccatcagttatgtagccatttcaacatcgatttcctgacgacacaagatatattaaactcagagcatctgacaaaaatagaagaacatgaaacttataatgtggttatcctgaaacaactatccatagtagaacagaatgaactcattccccaacagttatgtatcgtacaaggaaaagattatgtgctgacttttgcagaaaaagaaaccgatttattcaatgaaatcaatacggcactggaaaaaaatgtactgaagatcagaaacagacaatcagattttctactgagcgttatcctaaacagtgtaatggcaagtttcatgtcgcttatctcgaaaatggaagatgatttggaagacttggaagaacagttcttatctccgctttcacccattccaaccaaacaacccggaatagaagaaatacaagtttatcgcagaaactaccggttaatcaaaaagagtattttccctttaaaagaacagataaacaaactattccacgcagaaaaccagctgttacataaagcaaatcgcccgttcttcagcgatgtaaacgatcatctgcaatttatcttgcaaacactggagggatgcagggacctattgtcggctttggtcgatttatatttggcaaacaacgaccagcgaatgaacagtatcatgaagcaacttaccattgtatctaccatctttatacctctgactttccttgccggcatatggggaatgaactttcagtggatgccagagctgggatggaaatatggatatttctttgcctggggattgatgattgttgtaggagtcattgtatatttctacttcaagcacaagagatggtattaaaacaacaaattggacttatattattgtaaacgtatgcgaaaacaagaattatatgatcgggccattgcttattttaagcaagctattccggtagccgaaacagaattacactatgaaaatcccttccaactgctgatagctgtaatactaagtgcacaatgtacagacaaaagagtaaacatgattactccagccttattcgaagcattccctactccagaagccttagccaatactacacctgaggttgtattcgaatatatacgcagtgtaagttatccgaacaataaggcaaagcatctggtcggcatggcacaaatgctggttaaagactttcacggggaagtacctgatacactggaaaacctgataaagctaccgggagtaggtagaaaaacagcaaatgtcattcaaagcgtcgtgttcaataaggcggcaatggctgtcgatacacatgtatttcgcgtaagtcatcgcatcggactggttccccaaacatgtactaccccgttggctacggaaaaacatttagtaaaatatatccccaaagaactgattccgaccgcgcaccactggctgatattacacggcagatatgtatgtacggcacgcaatcccaaatgcgaagagtgtggactgaacggaatctgtaaggagtcactaaagagcaagatcaaataagctccatataacattaacaccaaacgattaaaaagaaaagccaactaaattacaaatgttttgattgtaatttagttggctttcatgtcatttttaaatattactatatacataaaaaatgccatatcactactttacagcaccgatatggcctatgaaatacatccgagcgttaccgctcgtgtgaaacatctttcttttattcatttatcaccataagtccatcgtatgccagatgtacatgctcaggaagttgcttgtctacttcggcatgcaatcccatctgatggctcatatgtataaaatacgtttctttcgccccaatacgtactacttgctccagcgcttccgaaagcgactgatgtgtccaatgtggttcgatacgcaaggcattcataaacaaataatcgagtcccttcaacacgtcatacgattcatcaggcatcgtaagcatatctgtaatccacgctacattacctatacgatatcccatgataggcagtttcccgtgcattacccgaaacggtatcacttcgaccgacttccccgacagattcgtaacctgaaaagtcttgtatggctctatcacagaaagcggaatactgggtactcccggataggtatgctctacaaaacaataaggcatacgtttttgcaggcgttctgccgtatatccttcagcatatacgggaatatcgcgaaagcgacaaaaaggacggagatcatccagtccccccacatgatcgtaatgctcatgagtaatcagtactccatcaataggaagaaaagtgttcatacgaatactttgctgcctgaaatccggaccgcaatctatcagaatgcgcaccccttcggtttctaccaacccggaacaacgcaaacgattatcatgcggatcggtactggtacatacctgacatgtacatcccacttggggtacaccagtagaagttccgctacctaatactgttactttcatcgttataaaaaacgccttaaatataatttacttccggataaatatcgataccgaatttatcctttacagaagttaccactgcactggccagctgcatgacctcttgtccagtcgcaccacctaaattgaccaagaccaacgcctgacggtcatgaactcccgcacgtcccaacgctttacctttccatccacaccgatctatcatccaaccggctgggactttcacccaaccttcacctgccggataagaaggtatatctggataagtggctcgtaaagcatcaaactgtttttgcggaatgaccggattcatgaaaaaactcccggcatttcctatcttcgccggatcgggcagtttttcctcccggatgcggataataatgcgacgtaagttttccaacgtcagcggacaggcctccttttccagctctgcacgaacattgccataatccaaatgccatacaggctgtttatgtaagcgatacgtcacatgcgtcacaacgtacttacctttcagttcctgcttaaagatgcttttacggtaggcgtaatcacattcttcattggaaaaccgacgaggttcgcctgtagctacacatactgtgtcgacagcaatgattaaatctttagcctcaacaccgtatgcaccaatattctgaacagccgaagctcctacttcacctggtatcaaagacaggttcactgcaccataccagttatgctgtacggtatatgccacaaagtcatcccaaatttctcctgcccctactcgtacatcaactatttcatcagtttcagaaacaatctcagcacctttaatggcagaatggagtatagtacctttaaaatcgcccgaaaagagcaagttacttcctccaccgatatgcaacaacggaagcacataactcttttgcttgaggaaagcacaaagctcatccaccgaatcatattctacaaaatatgcggcatatacgttcataccaaacgtattatgatgcaaaagagaatagtctttcagttctttcatatcctttatttatatataacaaattcctattaacaaatgttcagtcaatgaacatcttgttttagtcactcaaatcctcaaacttcatcaacatccactttccattacgatattcaaagtacagtgtattgctgaatccgttaccgaatcctttgaactcaatgatctttcgatctgtatccgcaacctccttttgtccgtagtgaacattcgtcaaccgttctttcaacaaaggcgggcggaacgaaaaccattgcccttcatcaagtgttgtttccagaatctgaaactcatcctccggatctacagtcacaaaccccagcggatcatgcaaccgttcacgctggaaaacagaatcgttggcaaaatgattataaaaatcaaaaaagtcttcgcgtccttcggatgccgaagcaagcttttccttattgatagcttccagataccagcaatcggaaacccgctcaaaatagtagcgctttactcttcgatccttcagataaatccaatccacctgaacactatgcacagccgtatccttttccatttccatatcttcttccttatcgaacaatacggtatataccggatcacgactgaataacggatcgtacacccattcgtctttcgacatacgttctacacggtcacctttatacaaggaaatgggaaattttactcttgaacgctgaaaacgttcatcggaagcaaaattataaaagaaatcagcaaaactctcgtcagccgtagctggaactacatcttccacttcttgagattcttcttgcaacgtatcgttaccgacagtcagcgaatcaatctgtttagttagtgtttcaaaaggatctacttttttctttcctcccccgcaagatgctgccaacataagtatacaacatccaaataaaacttttttcatcttagtgcttctgaaaaatcacgtgcaaaaatacgtttttttttcattttacacataacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgcacataaaacatccacagttttcttttttatgagcttaaaaagaaaaaatttcagttttaatccttacctttgcgcacaagaaaataataaaaaaagaatatgttagcaaaaatagaacagttacttcaggaagtggaaggcttgacagcttcgaatgcagaagagctggaagccctgcgtatcaaatatttgagtaagaaaggggtaatcaacgccttgatggcagatttccgtaacgttcctgctgaacagaaaaaagaagtaggcataaagctgaacgagttgaaaaaccgtactcaggaacgtataaacagcctgaaagaagctttcgaatgccaggacaacagtacagccgaactcgaccttacacgtactgcttatcctatcgaactgggaacacgacatcccttgagcattgtccgcaatgaaatcatcaacattttcaaccgactgggcttcactatcgccgatggtccggaagtagaagacgactggcatgtattctcgtcgatgaacttccccgaagatcatccggcacgcgatatgcaagatacattcttcattgaaagtcatccggatattatcttgcgtacacatacttcatcggttcagagccgcgtcatggaagtatcacagccacctattcgcgtcatctgtccgggacgtgtataccgtaatgaagctatcagctaccgcgctcactgtttcttccatcaggtagaaggattgtatgtcgacaagaacgtttcattcaccgacttaaagcaagtattgcttcagttcgcacaggaaatgttcggccctgaaacaaaaatccgtctgcgtccttcttacttcccgtttactgaaccgagtgcagaaatggatatcagctgcgacatctgcggtggagaaggttgtccgttctgtaaatataccggctgggtagaaattctgggatgtggtatggttgaccctgctgtactcgaagccaacggaattgacagcaaagtatatacaggctatgccttcggtatgggagttgaacgtattgccaacttgaaatacaaagtaaaagacttacgtatgttctcggaaaacgatactcgtttccttaaagaattcgaagcagcaaactaataatacatacttaaaacaggaaacgcggattaacgcagatttccggacaagtcgacagagaaaaaggcggtccgataaatctatgttaatccgcgtttttcaaaatagaatcagaagatatggaaaaggaacaccttgtcacacctagctactgctgcatactggcagccaattttctgttgtacttcggcttctggctgctgacgcctgttcttcccttttatttatcggaaatatttaacgcgtcaaaaaccacgataggcatagtgctttcttgctataccatttcttctctttgcatacggccgttctctggttactttctggacactttcgcacgtaagcctctctatctgcttgcctactttattttcacattgatttttgccggatacatgatcgccggactgcttaccctatttattatcttccgtattgtccacggtatatctttcggtatggtcactgtaggtggtaacacagtcgttattgacatcatgccatctagccgacgaggggaaggtctggggtattatggattagccaataatcttgccatgtccatcggaccgatgttcggattgtttttacacagcggaggagcttcctatactactattttttcctatgcgctcggatcatgcatactcggattctttgctgccaccctggtaaaaacaccttataaacctccagtcaagagggcacccatatcgctcgaccgatttatcctactgaaagggcttcccgcaggacttagtttgctcctgctgtcaataccttacggtatgacaacaaattacgtagccatgtacgccaaacaaattggacttacaaccgaaactggtttcttcttcacactaatggcggtcggaatggctatcagccgtttattcagcggccgactggtagacaaaggcatgatcacgcaagtcatctcggcaggactttatctggtatgtttctgttacttcggactaacagcctgcggctggcttatcgactggaataatacattcaccacggttctcttctttcttatttccctgctgctaggtataggattcggaaccatgtttcctgcatacaatacattatttgtcaatctggcccccaacagccagcgaggaacagcaactagcacttatctgacttcctgggatgtaggactaggaataggaatgttaagtggaggatatatcgcagaaattgcctctttccgtatagcttacttatttggagctacacttacagttgtttctctgctctatttccatttcaaagcaggaccccattttctgaaaaacaagttgagataaaatataacagataagcataggggacagctcattattctttatacgtaaaaacaagaatatgcgaaaacaatccattaaccttagttatctggaccgacaaaataaacgaacggaataactctatgtgatcataaatgaaggtgggaagataacccttatatctattcagatcctgcgctaccttatccatatctgccaccataataagcgaagcatcacgtgacaagttcgaaacacattcatcgaataatgtatgctgaggaacagccaataccctcgatatacaagaatcgatcttttcttgtccggaaagaatcaggatactatctttcgactgtgtctgaaaacttttcatacgctcttcaatttgatgcatagacgaatcgggagcatacattgaaccactcaaataaaaaacttcactattcagatgaatatcaaattctccccagcattccttactattggggaccaataaaggaatagcagccgtacgtccatacaacgtaagaaaattagcaatcttagtatgtgcaacagccgtaaagcccttgtcctgacgcagagaaatcttatctttttcagcatcaattactttttcaatcagtgctttctgataactgatggctaaaaatccctttcctgtataagtggcaacaaaatcaccattccttacgggataaatctcaatagattttccacgatagctttcctttctaggtacgaaatcaacgcctcttttacgcatcatctcgcggacaaacttcttgccagattcattcgtcttaaagtaaacgaccaaattacgtggagatataggagcatgaaaactcaccatcatataatccatccgattatgcaagtcgtgagtactattgattatataaggagccatctcattaccaattaccgacaaaagccccgtacgttgtagcgtatccaattgtcctgcgtatgttgtttgtggaaagacattaacaatagactcaatattgtctgtctctaaaagaccaatacaatcggcaggcacagaagccaacaggtcagtatcctttccactttccgcaaaactcagacgggcgaaactataaagccccactccgatgcagaataaaataatagaaagcactacccccaattttccgaccgtacgtagtttcatagtaattttatattttttatgcaaatataaacaattaattaaaaagtgcaaaatcagagaataataaaaaagcgaccttctaaagagaagatcgcttcattcagaagggtgactagtgggactcgaacccacgacattcagaaccacaatctgacgctctaaccaactgaactatagtcaccatataaaatgtatggctgctttaatgaaagggtgactagtgggactcgaacccacgacattcagaaccacaatctgacgctctaaccaactgaactatagtcaccatgttgattatcctttcaaaagcgagtgcaaaggtagcgaaagatttttaatttgcaaacaaatacaagaaaaatcttatcaaaaaagtatatgaggtttctttttatccaaatcatcgctatattcatcagggtaattaccttattatcggcatgtccccaagaatgcctcttatttatttgaaaaatacaatttatgaaagaaaagaatctaacaagcttcatgcagaaacttatcgtcagtttcctgcaggaaggacgactcggcacagcccatgtataccaaagtacctacaaccggattaagagttttaccggaggacgtccattaaaattcaacgagcttaccccttcgtggctaaaagctttccaaaactacctgttgtcctaccagcttcagtggaataccatttccacctacatgagaatgcttcgtgccgtatattttcgtgccgtagacgaagggatcaccatagaatacccccgcctgttccattgtgtctacacaggaacgcgtgtaacggtaaaacgagctgtcgacgctcaggtactgcagcatctttacaacaaacaaatacctcaaaacacaaaaatggaaagagcacgaaaactctttctactactttttatgctacgaggaattccttttgtagatattgcgtacctgagacgatgcgatttgaacggcaacatccttacctaccgacgccgaaaaacagggacatggattacagtacgtgtagaacctgaagccatgaagctcatccaagctttaaaaagtacggatatccattctccttatttatttccttttatccaaaaatatggtagaaacgagtatcatcagtatcaatacgctttacggatattcaactaccaactcaaaagattatcagaactgctaggcacacatatttctcttagtagctacagcgcccgacatagctgggctaccattgccaattatcagaactatcagcaggagctaatttcaaatgctatgggacattcatctgttaaagtaacagaaacttactttaaggtacattcagacgaacaaatcaatgaaatgaatagaggaatattaaaatatacatttcagcaatagaacattcccatataaatatgtctatcaataccaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtcaatacattaaataaaaaaataactatcacatagacatatccgttactttgcaggtaacagagaaaaatgaagaccttgagggatagaagtactttttctgataaaagccacaagttatttcatttaatagaaatatttatcaaaagaattgatcatcactatgtctggaaatatgtataaatctcatcatttatcatgttataaaacagattttttaaatacacaaaatgtttattcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggccgggctaatttttaacgaactattggtttatttaaaaaattttcatataccttttgcaataataactttttactatctttgcatttaaaaatattaatctgttacctgcaaagtaacagaactatgaaaacacatataaataacacagaaatacacattataaaatatgcgggacatgaagaatatcatttgcatactttttctgatggttggcatatctttgtcagcccagaatgttgcggttaaaacaaatctactttacgatgtttcgacaaccatcaacttaggagctgaaataggcctttctcccaagtggacgttagacttatcggccaattataacggatggactttcagcgaaaataaaaagtggaaacattggctgttgcaacccgaagcccgctactggttctgtgagcgattcaacggtcactttctgggagcacatctactgggcggagtctacaatgtaagcaattgggatacagactttactctcttgggcaccgactttggaaaactaaaaggacaccgttacgaaggatggcttgctggagttggtataggatacggataccactggatactggcaagacattggagtatcgaagctgaaatcggggtcggttacatttatacacgggcagacaagtacgaatgtccacgttgcggcgagcaactggaagacaataaaccgcaccattatgttggtccgaccaaggctgcaatcaatctgatttatgtattctaaagaaaaggagatagagagtatgaaaagaaaagcttgctatatattgccttatttagttttcggcgcttcgtttctattacctgctacagcttttacacagacacaaccctcccaaagtggtgtcagtataaatcatgtacagataaatcgggtacgcgacagtgtccgtatcgccttcgattttaattttgacaatctccagctacgttccaaccgttcattggtgttacagcccttcttcaaaggagatggtggcgaccaatggctccctgctgttgaagttatgggacgcagacgctacttatattatttacgcaacgacttactatcctatgctgaaaagccttaccgtgtaataaaaacaggtaaagacatacagcgacagcttccttatgcaatcagtctgccttatgagccatggatggaaaacgcttcactctatttgggagaagacgaatgtggatgtggacaggtcatcaatatgaagcaacacccccttgctgtagcagatatagcctggcatcctgccctcgcctatcttacgccaaaagtagaaactgtaaaaagccgtcagctcagcggtcatgcctatctggattttccggtcaacaagaccgaaattaatccagactaccgccgcaatcctgaggaactggcaaaaatatgtgccacgatagatagtgtacgttccgacaacgatgtacgtatcgtacagatacacatcaaaggttatgcttctcccgaaggcagttatagctccaatgcccgactggcagaaggacgtaccaacgctttaaagcaatacctcattgaccgttatgcgctggccgacacattatttaatatagccttcgagcccgaagactggcaaggtttccgcaagtacgttgagacaagcaaccttccggacaaagaagagattatacaactgatagacagtaatgaagatatcgacgtcaaggaacgccagatacgtgcacgctatcctcagtcatatcgtaccctattggaagactgctaccctgccttacgtcattccgattatcgcatagattatgtgattagaggattcaatgtggacgaagcgaaacagctcattcatacgcgtccgcaaaatctcagcctcaacgagatgtttgccgtagcacagacctaccagcccggcagcgacaatttcaagcatgtattcgatgtagctgtacgtttgtatccggatagcgaagttgccaacctcaatgcggcaaacgccttacttgaaaaaggtctggcgcagcaggcattgccttatttaatgaaagctggtgaaagtccggaagccgcaaattcgcggggagtagccatgcgaatattggaacggtatgatgaagccatcaagtggttacaacaagcagataatgccggactaaaagaagcaaaaatcaacttgtcaggaattgaataaaaaggtctttagagaaactgattaaaaagaccttaatagcaataggatttattaattttaattaattatatagcaattatgaaaaaggtgaagtatttaacattgctatttgcagcaagtatgtttgccgcatgtagtgattcgttggatgacaacagaacagaaaatggaggtaccactctcacgacaggagacggatatgtaaaagtggctattaatttgcctaccactagtggcatgtcaagagtaaatgatgacaacatgcttgatgatggtttggaaggagaatatgcagtagaaaacggaataatagcattttttaaaactactacttccggaaatcctgatgccagtgcgacattcgtcaaagcttatgacttagggacattaactcaacaagatgatcagagtgatgctcaagtttctacccgggtaacaacaacgaccgaagcaccattggtaggcactggtgaacaactttatgcactcgttattctgaaccctactgatgctgtcgcttcagtagaggctacaactgggacattaaaaattaatggtgaagctttaacctcaacgtctacactttcagctttacaagcaaaacttgaaaatcagacattatctaattattcaggaactaaattcttaatgacaaacgctccattgtcaactgttgtaggaaatagttcagcccttgctactactgctactgctaagacattggttcctgtaaccgtttatgaaacaaaagctgctgccgaagctgataaagaccctgcaaaaatctatgtagagcgtgtagtcgcaaaagttactttgtcaggatttacttataacaatagtgaatatactaaaaccgctacagtttccaataccaaaccaaatggagatgacgaaagtgtctataacggtgatataatcaagcttactggctgggcattaaatgtaaccaataaatcaactaaattggtacgtgatgtaaccggattctctggttggctatcaactactgataacaatcccgctcgttttgtaggaacaaatgctattgcaatgtcaaataatcaatcttattatcgtatttattgggctgttgatggaaattatacaaaggatacaacgatacctgctagtgattttacaacctatacaaatgccaatcagccaggtacagatagttggaatgcaaatgcggaacatgatcaatctagttccccattatattgcttcgaaaacacgatggatcatagtcaacaattacaaaaccgtaccacaagcgtattgctgaagactgaatatcgggttaaattcagcgataacgatacaccagctgctcgtgatttctttatttgcggtacaaccccgactaaatatcctgctgcagacataactgagggtagcattaaaggtatagtttctcatgtaaaagaaacagccttctctggagagtcatctctagacctgcaactgaacactaacgctgccggaggttcttatgacagtgctgacgatatgaaaaaactatttaaaataggtgaatcaacagacctgacaaccgaacaagctgaagcaatctggaatacaattggtacaattaagtactataaaggtggagtaagctattattacgcaaccctaatcagacatttcaatgattcagaaacgccatgggatgcgagtgcccccacctatgcattgaaacatctgggacgttatggcgttgttcgtaacaactggtatgacattaatatcactagtatcagtggtcctggtgatcccgaaattactactccgtcagaagatcctgatgaccaagctgaaggctatgttcgtgccgaaatcaacgtcctctcatgggctaaacgttctcagaacgtagatctataaatcatattattaaggtagggactgtgattttgaacacaatccctaccctactcaaccaaagatataaaaacattttatatgaaccattgtgccaaacatatactaggggtaggctggctggcatgcttgctgctggtcttatccgtcacgtcgtgtaccgacttaattttcgacagccgtgaagggtgcgaacgaggagtatacgtaaactttaaatacgactacaacctttatcgtgccgatatgtttgccgatcatgtaggcgaagtgacactttatgttttcgatgaacaaggaaactatattacacagtgtacagaagctaatgaagagggaaatgaaccgttaaaaaaggctgattacgccatgttcctcgatttacctgagggaacctaccgctttatagcgttggcacatcaacgcaaatacgatgacctgattcaagaagaaggtgccaagttccggcgcacggaaatgaacgaaaacaatgtgatggaggatttgaaaattacccttgatcacatttcaacatacgaaggagaagtgtatatagaccatcagaatcaaccgctcgataccctatggcatgccatgtccgaggaaaccgtagaagtaacacaaggaaaaatggctcaccatacgatgtctttagtccgtaataccaaatacatcagtgttaccttgagagacatcgaagaaccagatttaatggatatcaacgattatgagttgtacataaaaggagcaaatgtacagctaaatcatgacaactcggcaagtaatcaccccagagccatctgtactcctttcgtgacttggaacacgaaagatcccgacagtgacacccgtacttcggtaggaaacatgggacatgccgattttatgacttcccgcattttcgttcacgataacttagcagatgatgaagtactgatagtaaaaaataaaaagacaggcaaaaccgtgatcgaagtaaatttacccgacttgcttagccgtctgtgtaactacgacgagctgcatcgctactcccgtcaggagtttcttgaccgcggctacgattacaatctctcattcttcctgtctggaggcaattgggcatacgctaacgtatccattggcgtattgggatggagcaaacgtattcaaaatgtatcattaggagaataaataccatgaaacgacccgttctgacatacttatttttcttctgtctggttctgataaccgcagcttgcaaggatgatagccttccagcctcttctgtagaaaaggaaggtggaagcaatgtatatgtaagcattgttgtgaatacagaagattcacaaaacagccgtgtttccactcccactcccggagaagatggagacggcccacaaattggcgtaaatgaagagaatgtagtacacgacttgaatgtattcttctttcatacaaccgatagaaaaggactaaatacgaaagatcagtcagtaaacgttgtttcaatatatttcgaccaactaacaggtagtacgacaaaatatacaacagaaacgaaagagatagaaggtttagagataggttcgtcttataatgttctggtcattgcaaacttgggcacccctttaaacataaccaccttaaatcaactgcgtgagtaccccgtttcaactccgatagtacaaacgaattattttgtaatggcatcttccgaaacgggaacccctgttacaattcaagccacttccaaaaacaatccgaccgtggtttcagcaaacgtagaacgactggcagcacgggtggattgtcattgggatactgagtatttagtggagaatgatacagttatcatcacacaagccatgttagtcaataaatatacaggaggaacgtatgccttcaaacgagtaaccaattctactacagactttacaattgattatttgggagcggaaaatgtagagggaaatcgtgctgcaaattatgtcatagaccccaaaacactgaaacaaactgatatcgctgctgattatcagccctattttcctacgtacaacaattggagtgctacagatgactggaaatcattgtctacagctgtaacttctactcataacgatgtaacctattccttgctcgactatacaacagagaatgtggtaaaagcagaagatagtaaaaatacatgtgccacttattgtaccggcattgtgtttaaagcaaaatatcaacctgcaggtatttctactactgatggtatttctactactgatggtaatcgtaccttttaccgatataacggtaaatgctatgcttcattaccaaaaataaaaaatgtaatcggagatcaatccattagtgatgataatttgtcccaatttggtattactaaatatcaagacggcatctgttattatacttactggataaaacatgccgaagacggagatgatacaacggtcagtccgatggaatatgccattgtacgcaataacatctatcagataaacgtaacaggaataaacgatatcggcacggtaacgcctacagactatggcttgtatttggaatgcacggttgccgactggatttcggaagctgaaatcacaatcgatttcagcgataattatgatggagagatagcaggaattcatgttgtacagaatcaagatcaagatgctgtactcgttgcttatagtcaggacaacgaggtccgcgatgctcaattctctttcacgatgaatactccggtaggcattggatggacggcccaccttaccaatccggatgattttgagtttgtaggcgactatcatggtgtaggaggtcaaggtcctgtcatgctgcgtatacaccccagaaaaactttcgaggaaggagtaactcgcgaaacggacatgtatatcaccatagatacagacaatagttcattagacttcaacgtgagctcgggtgataagttcccgggaaataaaaatattatccatattcagcaagttagcacaattgaatatgacaatcttctaaataattcacaaaactgagcactatgaaaaaaagaaatattatatatagcattgtttgtacattgtgctgtttcatctgcttttcgtgttcggatgaaaaaggcaatccccttgcctcttctacagaaacaggactaaccttgcaaataaacgctggacagaatacttttacccgtgccgatggaattactgacagttccgcagaaagtgcatgggacaacgtcattcgttatttggatgtattcatattcgatagtacgacgggaaaactggttccgaattgttatttccattttggcgacggctcaaacaatatcgttgatccggtttgcctgatttcgggcaattggaaaaaccgtttccagaatcacgaaacttgtgacgtatatgtgatagccaatttacatatccattctccaggaaacaatacagcaagtgaaactgatttagaacagattcaaactctcagtgatttgcagcaactcgtagacgaatatatatatatatatcaatccgtttcacaagatagtaaaatgccttttaccatgagcgggtatagcatgttgaaaccggctgaatcttccaatgtatataccatatctgttgaattgacccgactggccgcaaaaatagagatatctttagatttgaagtttacaacagaccaaacaacaatcaatggaactacctaccagtaccctaccaatgacgatattggtcagttgcaatatagtgtccataactatgcaacgaatgcacgagtcttgcccggtaatgatgatacattcggatataccatagcatctgcagcagaaacgagccttaagtttatggacaaagacgattccggcaactcagttcctaagattattgcctacacttatcctaccgaatggagtaacgatatcttaaaggaaacgtatgtcattctcaacgcgcaactgaaaagaactactgatcaggggggagatcctcaatatatgaacaactattacaagattcctctccgcctctctaccaacgataacaagaaactggagcgtaactacaggtataaagtaaaggctaaaataacagcgaaaggaaatgccacacccgatgagccggttgaagttacaaacgtacaatacgaagtagctccttggtatgatacgaatatagatattaacggagacactccactgtatctggaactgagtgaatatgatgtggtgatgcgaaatgtggatacgtatgatttaacgtttgcatcgtcaagccagatagtaaaagatctaaccagccaaaaagcagaaattgaaatcaaggaaatttattacaaaaataaatatggtaaaaagatagatttaacgggcaacaacgaaattatgggcaaaacttatttaagtgtagatggaggtttaaatggtcatctggttatacacagccccatacccgaaaacaagaccatccgttatatcacactaacggttaagaatgcgcaatacaatgagtctgatcaaggtactcacagttgtatcaagaccgtaaccatcaaacaatatcccttggaatatattacaggcatctccggattgtattcgtatttggatgaaaataccggagcatggccaaatgacctataccaattaaattataattcttgggttgttgataaaaatacggaaccacaacaatatactataaacaaatcattgaaggattctgcaattgttaaaggattaaatggacacataggcgataataaagaaatgaaaagtaaattctatgtggaaaataataacggtgaaggccgaatttttcgtatagatctaagctatttaaaggactatgaaaaagttccagccggaacaggtaagtataataatgtatatacttatgaaggaaaagaaaaagggaattacacaattacagcaacagaatcagagtggggagattacacccaaaatagtgataaagattatattgaaaaaaatgtggatggactaggtggatatacattagcaataaaaaatgttggaaaaaataagggtgactactcccatagctatatttcccagcaaggaggcaactatattagaactaaagatacagattttattcctaacttggtatactatttggaagataatggtacagcttccaataatcagatgtatcatgtagttattacgtccacttctggagattatcaattaggacgtccaatcatgaaagaggagattgttgatcccaataatcttgacaatgacaagctggtatctccttctttcatgcttgcatcacaattaggaaatagttctacaataagttgggaggacgctaaaaatcaatgtaagaattatgtagaagtaggcataaatggagaagtctacgatgactggcgacttcctaccgcggctgaaattaatatcatcattaaatatcagacagatgataaggtaaatacgaaagataacagagccgtaatggattatgtattgaattatgaaggccaaagcaatcctgattattgggtttcacgctctaattacttcatgcatatacctgcaagtggagcaggaacattagaaaaagaagaatcaagtgaagccgagcaccgtgtccgttgcgtccgtgattttcatgtcggagaacctacagaataacctttcgaagtaaaaaaagaataagttatgattaagaaaatagcattctatctcatagcaggcatcgtaacgatgctttctggctgtgtcgacccggatatgggaaagacaggcgataccagcctgcccgatgaactgagccttcggttcagttttacgataccgggaaatacggtagtcaatacccgctctattgaccccgacggagagcctgtttcatctatctggctgtttctcttcaatgaaagcggttattatttagggcatgtacgagcaaatgaagttacatacgaaaaaacagataccgataccggtacatatgagggaggtacattctctaccccttctatccccagcacggtgcgcagcatccactttatagccaactataatgcggcagatgtggacgacagtgaattgctgaaccgtacagaaaaagaagtaatgacccgttttacctcttcatcgggccgactggtatattggggtcggaaagtttttaattcagaaaccaagttgacttcatattttaaagataagtccacatcgccgatcatactttaccgcaatcaggcggctgtcacttatcagaaagcagagaatgtaacggatgaatttgaaattcaaggttttgccatttgtaatacatacgccaaaggtacggtcgttccttacaatcatcagaatgaaaaaaatccgttcgatttcaatttaacaacagagagccaaggacgtgctgtccacgattatgtgacactctgctctggtgaagatctgataaaggcaaccgatccggaggatacggaagtacagaatgaatggggactacgctatgttttcgagcatgaaaatgcacaggatgatccgatgttcgccatctttaagattgacggcaactattacaagctgatgattgtagatgatcaatccaatccgtataagattatccgcaatcaccgttatattttcaacttcctcagtgctcccccaaccacattgggatatgccacctttgaggaagcaaaaaatggcgtagctgccaataacgtatgggtatctatagataatgaactgccttccatcggcgacggaacttctgcgctgacgattgagggagaaacaacccgaatctatacggaacgaaaagatgaggtcatcaactttacctgcacaggaggaattacgtccgatcaggtaactgctacttggctttccaacgaaggactggcaagcagcgacctgaatttacagtatgatcccgctaccggtaagggaagtgtgactgtttccctgaatgaaatagccgatactccccaatatggtacgttacagataaaggcaggaaagtatccgcgcaccatacagattgtctatttgaataaattcgactttgcaccggtatggacttccagttcagtaccgagacgttccggcgaaccggtgtctattgtattcaatatacccgacacctatcccgaagaacttttcccggtagagtgcaaaatttcgtgcaacctgttcgatgcaaacacaaacaaccagttggaagtgatagaggaagaaaccgctttcaccatagatggagtgaaggtagaacgagactgggattacaaatatgtatacaaagccgacaagccgggcttgcatcgtgtggacttcaaaacgctgataaacagttaccctgataaccctgacaatcctgcaacggagaacgaggtattgacctggtttctggaagcaccgtatttcaatacgatagaacgaactatcaatatggtgaatgatgagtatgctgaccagaagattattatttacgaaacgacattgaatggtaatcaagcatccggtacttacgaacgtgagattgctcccataaaaggacagactttcgatttaaaattctatctggaagacagtattccggcagaaaagcagccggcaggaacgaaaatacgtatctacatggataaggcggtagaacctggacatcaggaaggtaagtggcccgctaatttaagcgaaacccaatatgatgcccccaatgcaggccgatattttatctatacggttccagaaggcgcaacatataatgaaaacaataacaccagataccttgtatccattcctttccgcacggtttcggctcaatgtgaaggttatgctcgtattgcggctgccagtaccgatggcaacgatgctgaccattgctataagtcagctattgttactcgtgtcaataatccggaagcgtataactttaacttacaagctaataatgcaaaagagctttcattaccctacggtacaggacagaaggtaacactaagtatcacccccgatttggaaagttataccgtatcttcctgtaaaatcctcatcaaaacccaaaatctggaaccggcagacaaggatgctgttgtatgggacaatgagcgggacgggtacgtatggaccattacagacctaagtgcccaaaagtatacattggacatgctaacaaaagacgtcgtaagtgctgaaaccgtaacaatcagcgaaataagcggcaatgtagcgttttatgaagatgagattacgataaagaatcagattcttagcggaaagatacagattaataatggctatacattccagacgacttctcctttcattgctttggagaaatcggatggtacacgtatcggggcgtttactgtaactccaaccattggcggaaatacaggaatctatcagttgactctccgtggcgaatacgactttaccgaagatgaagaattgaaggtgatttattcgcccttaaatgatacgaatgtctatgtaggccaaacaaccattacggaattgttgaagtcgccaacgttgaatttacaattgcaacaatagcccggtaacctaatactgacagatcatctatcaatcataacacaaaaatctcctgctttagcctttgtttattgatggctaaaagcaggagatttttgcttcggcaattttattttaaaactgctttcctatggttgagggtatgcatcccccatggaatcagtctttgtaaatagccttctttccggcaagcaacgtattcttcatcaacgatacgatggtcatcggtcctactcctcccggaaccggagtgatgtacgagcatttaggagcaacttcatcgaatttcacgtcgcctgtcagtttaaagcccgacttctttgtcgcatcgggtacacgtgtagtacctacgtcaatcactactgcaccttcttttaccatgtcggctttcacaaagttgggctgtcccatggctgcaataataatatctgcttcacggcattctcttacaagatccttgctccggctgtgacaaaccgtaaccgtagcatcgcccggataggctttctgcatcatcagcatcgccatcggcttgcctacgatgttgcttcttcccaaaatcacacatttcttgccctgagtttcgatgttatagcgtctcagcaattccaaaattccatttggagtagccgatacataacaaggaagaccaatcgacaatcgccctacgttgataggatggaaaccgtccacatccttgcggtagtctattgtttcaatcactttctgctcggagatatgtttgggcagaggcaactgtacgataaatccgtcaatatcgggatcgttattcaactcgcgtacttttgccagcagctcttcttcagttacatcgctttcgtaacggatgagcgttgacttgaaaccacatacttcacatgccttgacttttgcggcaacatacgtttcacttcctccgtcgtgtcctaccaacaccgcagccagatgcggacgcttgcctccacgggcaacaatatcggctacttcggcagcaatttcttgcttgacctgttccgaaacctcttttccattaatcagtgtcataatacaaactgctatattaggttattcatagtactaacaaatttacgacttttcgacggggcctgacagagatggaatctgtgtttatattttattaactttcatttgaccggcaggtccgagtatttcttatgcccccgtaccttcgactgccacaagatgctgaacgaaaatcgtccggacacgttgaagcagacggcattatccaagttctcctgccggtcggctttaaactgcggacacagacgggcatattcttttctcgcctgtatcacggcacggaaatttccccagtcgcctttcagcaaaaagacacatgctgccacatagtccagacacgcccgtatcttcataaccggacgcaattcttcgggaggaaggtttttatacagcatcagcaggttattgcggaaattcagaaaggtcttccgcggattctctttcttcagcgtagctcctcctacatgccagactttgctttcgggcaggcagaagagtttgtaaccacggcttcgcaaacgccagcacaagtctatctcctccatgtgggcaaagaaacgtccgtccagaccgcctacttcacgatatttatccaaccggataaacaacgcagctcctgttgcccaaaaaacagatatcggtgtgtcatattgtcctttgtctttttctacgacctcgaagatacgcccgcgacagaacggatagccgtagcggtcgataaaccctccggccgctccggcatattcaaaacgatccttctgcttccagtcgagcagtttgggctgacacgctgctacatccggatgaaggtccatatattccaccatcggagtcagccagccgggagcaacttcaacgtcgctgttgagcaataccgcatattcggcatcaacttgttcgaaagccttgttgtagccgtcggcaaagccgtaattccgatccaaacgaatcagacggactgctggaaactcctgctccagcatgcggcaggagtcatcggaagacccgttgtctgctacgcacacttctatcccctcaccagcagaaccagccagcacggaaggcagaaagcggcgaagcatttcggctccgttccagttcaagatgactacagaaaccttgttcatatcattgttcctttcagtgcagtaccttcttcattgaagtcgcccagacgaacccgtaccaaatgattgtccagattgtcgtcgtgattcaactccacacggatatagtttgccgtaaacccatgcattggcgttccggctttggaatgctccatcagcacggtggcctcctgtccgatgtgacgggcatagaaagcccttgtcttttcgtccgacaaagccaagagccgctggcttctctgatgcttatcttcgggagaaaccacataatcgatcttcagcgcctgtgttccgggacgttccgaatagctgaacacatgcaactgggttacatccagactacatataaactcgtaagcctgttcaaaatattccggagtctctccgcgcgtacccacaatcacgtccacgccgataaaggcatcgggcatcagcgatttaatcttctgtatcttgtgtgcaaagagtgccgtatcgtaacggcggcgcatcagcttcagcacctcgtcgcatcccgactgcaacgggatatggaaatgaggcataaaacgacgcgaacgggatacatattctataatctcgtcggtgagcagattgggctcgatggaagagatacggtagcgctcaatgccttccacctcgtcgagtgctttcaccagatcgaagaaactttctcccgtcgtcttgccaaagtcaccgatattgacacccgtcagcacaatttccttaccgccttctgccgctacctgccgtgcctgctctaccagatcggcaatctttccattacgactccggccacgtgcaaacggaatggtacagtaggaacagaaataatcgcacccgtcctgcaccttcaggaaatagcgcgtacggtcgcccttggaacacgaaggaacaaaggtacggatatcctttgtagccgtagtgatagcctcaccatgctcgtgtttctccagattgcccaaatatttcatcaggtcgcctttctgctcggctcccaatacaagatctactccttcaatgtctgccacctgtcccggcttcaactgagcatagcatcctgttaccacaataaaggcacccggatgttcttttgccagacgatgaatggcttgccggcatttcttatccgccatttcggtcaccgaacaggtattgattacacaaatgtccgcctgctcgcccttacgagcggtacgcacacccgcctccttcagtattttaccgatagtggaagtttctgcaaagttcagtttgcagcccaatgtataataaacagcttttttattctgaaaaatagtggtatctgtcatacgttaatataatgattcgaattgcaaagttacgcattattatctgaacacaaagataactgcctcatcttacccccaagaaaagataaaatcaggatcaaaaagagtctctcctctggaaatctgcccgtcccttcagagaaaatgggaaaaatcgtttaaatatacgaaagatttacgtatttaccttatcaggaaacatcttttaggaagaaaactatttaaaaacatattttttttgaaaaaaaacgctccaaagagaacaacgtatcaaaaaactctatatctttgcagtgttttaagaaaacgacataagtattacagatttaaaaaagcaaagaaaatgaaaaaattagtatttttgttcgtagcattcgctgctgtatctttcgcatcatgtggtaacaaagcagctaacaatgaagaagcagctgattcagcagcagttgaaacagtagaagaagcagctccggttgttgactctacagcagttgcagcagattctgcagcagttgattctgcagcagtagttgctgaataatttcgaacaacattcgagagaattgaaagtctggcgcatgcgaaagcatactcagactttttttatgcccttacgtttcctcattctacaggttccctttcctaaaaaaaactcttgtaattcaagacataaaatttactttccacaactactccactccacaaagattccaattctttcgcagcaatcgtacagatccccataggatgttatccggatacacactattcatttattgcacaaagtttaccaaagacataaaaaaaagaaatcccgagtagaataaaagttctactcaggattttatcaagtatttacagactgcaaaattaagcttcttctgcaacgacttcgaaaggaatttcaacagaaacttccttgtgaagtttaacgattgctttgtagtgaccaacttccttcactgcatccttaacaacgataatcttacgatcgatgttgtgacccaatttagcaagttcttcagcaatctgaatattacctactgaaccatagatagcacctgtagcgctaacttttgtagcgatcttcaaagatacacccttcaaagattctgcaactgcttcagcatctttcttaatcttttccaatttgtgagcacgctgtttcaattcttcagccagcattttcttagcagccggagaagcgataactgctttgcctgtcggaataagatagttacgaccataacctgacttaatggttacaatatcattcttgtagcccaagttaactacgtcttctttcaaaataatttccatactcttattcctcctttaattatttcatcatatcagttacgaaaggcagcaaagccaagtgacgagctctcttaacagcctgcgcaatacgacgctggaacttcaatgaagtacctgtaatacggcgcggaaggatcttaccctgttcgttcaagaatttcttcaagaattcaggatctttgtagtcgatatacttaataccactctttttgaaacggcagtattttttctttttaacgtctactgaaggcggagttaaatatctgatttctgattgttgctgtgccatgattagttttcctcctttttagttgatttaacatttcttctcttagcagcgtattctgcagcgtatttgtccatcttgaaagtcaagaaacggataacacgttcgtcacgacggaagtttacttcgagcttttcgattaccgacggttctgctttaaattcaatcagctgatagaaaccagtagatttcttctgaattgggtaagccaatttcttcaatccccagttttcttcattaatgatctccgcaccttcccctgtcaggatagctttgaacttttctaccgcttccttcatctgaacatcagataaaacgggagttaaaatgaaaacggtttcgtattgattcatactattcgttgattaaaatattaataataaattttcaaatgcggcgcaaagttacgactttttctctaatatacaaacgattgtgacctttttatatgataaagaatgttattttgaggcatttccctatagaatatatggtaaaagtatcgtatatttgcgtagttgtttaaacaataattagatgatagaacagtttaattttgacatacagcttatttttgctatacttaacggaaaagtttcagctgcaatcaatcgtaaattaagccgtaactttcggcaaaacggtatggacattactcccgaacagtggacggtattattattcttatgggaaaaagacggcgtaacccagcaagagctgtgtaacgctacattcaaagacaaacccagtatgacccggctaattgataacatggaacgtcagcacttggttgtacgcatctccgacaaacgagatcggcgtaccaacctgatacacctgacaaaaaccggaaaagaactggaggaaaaagcacgctttatagccaacaagacattgaaagaagctcttcacggactcacactggaagaattgagagtaagccaggaagttctccgtaagatatttaccaatacaaaagactaatagtaaggttttttattttttttcatcaaataatttcctcaatacaagaattatcctttaatttgtaaccaagaaaaaaataaaccataaaatagaagacacacatgaaaagctttttaaagaacttaggattgattctggttgtaatcggagcagtaatcctgattgcctgctatttcggaggcaatgtaaacgacaatgcagttttagcaacttctctggttctcattatcgtgggattaatctcttacatcatgctgaacaaacgtatcgttgagtaatattgagtcaatccagaaaagaaataaaaaaacctgaattcttacggaattcaggtttttttgtgtctatgcttttcatcattcctgttcaggagtaatcagcttatatcctttaccatggatattgataatctcgatcgaatcatcatctttcagatgcttacgcaatttcgtaatgtatacgtccatgcttcgtgcattgaagtaattatcgtcaatccagatagtcttcaacgcaaagtcacgctgaaggatttcgttggcatgtgcacaaagcaatcccagcaattcagactccttggtagtcagcttggtctgtttgtcaccgattgacagaatctgcttctgtgtgtcgaatgtaaagcgaccgattttatacaagttgctttctttgttacgtttgccacgaacacggcgcaagatagcttcaatacggaaagtcagttcctccatactgaaaggtttggtgatgtaatcgtctgcaccaatcttgaaaccttccagaatatcttccttcaatgtcttggctgtaaggaaaataataggaaattcagcatttgcctgacgaatttcctgtgccagcgtaaacccatctttctttggcatcattacgtcgagcacacacaaatcatacttattcttcagaaaggccttgaaaccggcttccccatcagggaagagctcagccgaatatcctttcgcctgcaaatattctcttaagagcatgccaagattctcatcatcctcgcacaacaaaatacgcaatttttcgtccatatcagtcttctttaaataaaggtaatacaataataaatttagttcccacattcagttcactttcggcacgtatcgttcccttgtgatctgttatgatctttttcacataggccaagcccaaaccaaagcctttcacatcgtgcaaattgcctgtatgaacccggtagaacttttcaaatatctttttcaggttttccttcttgataccgataccattgtcttctatcgatatatgaagttttcctgattcattccaagtacgaaccttcaaatggatattaacatctggcttcttatacttcaatgcattatccagaagattaaaaatcacattggtgaaatgcatttcatctacgtagacaaacgggtcatctgcatcaagtgctacatccagtgttccattacaattctcaactttcaaccggaaggtattggttactccgtaaatcagttcattggcatctacctctttctttttcaacgtagctttctgacgctcaaacatagacatctgaagtactttctctacctgaaaacgcaaacgcttggtttcatcgtttattactcccgaaatgtgtttaaacattgcaggcgacttgctgattgccggatcgttcaacatctgcgcagccaaagagatggttgagataggtgtcttgaactcatgtgtcatattgttgatgaaatcgttcttaatctctgtaagcttcttctgccggaagatgatgtagatggtaaagataaacgttaccagcaataccagcgtaaagatgatagacggaatcatgaaccgtacggaactgaagatgtaattatccattgtcggaaagaatacattcacaaatcccatcttggccggaggatctttttcaaaaagcaaccgtgagtaaactttttcattatcgtattcataatccgagcaacgataaatttcttttccatcacgatcggttaccgtaaaatgataagggatatctactccgttattcttcaactccgagttcagaaaataatccagctgcttaaagttcacccgttctttcaacggcttgtcgcttgcagtatacaggatgttataaataacctcattcagcaaggcacgctgataaatataacgttcctttacaatttcctgtagggtccgggaagtctgaggtatattcttccctgtagaaataatctctttaggaatacttgaaggacggtttatcaccgttttccattcaaaagtagaaatggtacttccatcggaagagccaatcagtacacttccactagactgtgactgatgctgcatctgaaactgctgggaaagctgtgctgcacgttcggtagccgccacgtctttttccagatactttttagtttccactaactccaggttatgcacagcctgggcaaggcttcgtccgacgttttcttcgaactgttccttacgcatcttgaccatctcttctatatagcttacctgtaaataaagtagactcagaaaagaaagccccattacaatacctaatatccaaatagttgactttttcatggaggcaaatttaaacggctattatttacgagatactttacttaacatgttttaatctgcgattcttttatattaacaaaatccgaacttttacatgttattttaaaaacttcacatcccgttttccgcggtcttaatgcaaaaataataaaattttaaattaataacaaacaaagtaagctaattgtttaagcttcgttaaataaaaaaggccgcatttttaagaaatgcgacctttgtaatctataaaaacagcaattagaaagtttatgcttcttctttttcctgttcttcgaattctttcatcaacttattctgaacatccgttggaacaagttcgtaacttgcgaacttcatgatgaaagaagcacgaccacctgtcagtgagctcaaagcagtagagtagtttgacatctccttcaatggaactttagcagccagcttttcatatcctttttcgctgctcatacccataatcatacctctacgtccctgcatatcactcatgacatcgcccagcttatcactcggaacaaacacttccacgtcgtaaatcggttccagaatcttcggtcctgcatttttgaacgcttcgctgaatgcatgacgtcctgccagcatgaaagagatttcattggagtctaccgggtgcatcttaccatcatatacaatgacacgtacatcacgagcatacgaaccggtcaaaggtccttgttccatacggctcataatacctttcaaaatggcaggcatgaagcgagtatcgatagcaccacctaccacactgttaacaaataccaatttaccgccccattccaaatcgatggtttccgaacttttcacgtttatcttgtactcctgtccattgaacttatagacttcaggagctggcatgccttcataataaggttctacaatcagatgaacctcaccaaattgtccggcaccacccgactgtttcttatgacgataatcggcacgggcagccttggtaatcgtttcacgataaggaatcttcggttcgtagaactgtacctgaagcttttcgttgttttccagacgccatttcaatgtacgcaaatggaattctccctgtccgtgtaccagaatctgctttaactccttagactgttcaacaacccacgtaggatcttcctcacgcatacggttcaatacagccatcatcttttctgtatcagcctcattgaccggcttgatggcacgtgtatatttcggattcggatacttgataaaattgaatctgttttcgcaatccttgccgttcaacgtattaccggtcttcacgtctttcagtttcaccgtacaaccgatatcgccggcacgaagttcgtctaccttttcacggttggctccagcacatacatacagttgggccatacgttctttagagccacggtctgcattactcaagtcatcaccttcgtgtaccacaccgctcattaccttaaagtactgaacatctccgatatgtggctctacagctgtcttaaagaaatacaaagaagtaggtccgttggcatcaggaggaacaggaacaccgcgggtattatgaacaactggcatttcatcgacaaacggaacgacattgcccaagaactccatcaagcggcgaacgcccatatccttaccggcacatacacagaataccgggaacatgccacgtgcagccaatcccttacggataccttcacgcatttcgtcttccgtcaatgattcagactcaaagaagcgttccatcaaggtttcatcgtgttcagccgcagcctcaaccagcgctttatgccattcctgagccttttccatttcttcggcagggatatcctctatggtaggtgcaccaccatcgggtccccatgaatattttttcattaaaagtacatcgatcaatgaattgaagtcgggtccggtagccaacggatactgaaccggaacaactttagaaccgtaattttccttcaactgttccaatacatggtcgaaatcacacttttcactatcaagctggttaaccaggaagataaccggtttacctaacttttctgtataacgaaaatgattctgcgtacctacttcgggaccatactgaccattcaacaacaaaatagccgtatctgtaacgttcaatgccgtaatagcagctcccacaaagtcatcacttcccggacagtcgatgatattcagttttttaccattccactctacatgataaacggtagagaagaccgagtaaccatactcctgctctaccggaaaatagtcgctgactgtatttttggcagtaattctgccgcgacgttttataataccactctcatagagcagcgcttctgtgagggtggttttacctgatccgtcattgccaagcagggcaatgtttttgatttcattggtctgatatactttcatggtatttcaagatttaattagtaaacaaaaggatatgcttttcatatctcttacatagtgatgcgcaaattagaaattaatgagcaaaaatgcaacaaattcattcgtgttactaaactatgtttttagacagaaattaacgatcaagactggatattcctcctttctcaaactgggaaaaagcaataaaaaaggccatgtcacagcctcttactttaccgtgacatgaccttttttgtcaagtattatagcgataatatactattaccagatattgacacgcttttctggtgcaatgtacatcgggctttccggagtaatatggaaagcatcgtaccaagcctgaatatgaggcagcgcaccgtttacacgccattcacccaatgagtgaggatccgattttgtacgagagcgaatttcctcatcacgaatgttggcagcccatactgtagcataagccaggaagaaacgctgttccggagtaaatccgtctacgttacccagaggatgttctttcgtagcattctggaatgctaggaatgcaacattcaaacctccatggtcggccagattttcacctaatgtcaattcaccatttgctttcagtcccggcaatacttcgatgttgttgaagaaatcaaccatcacttttgtacgagcatcgaaacgttcagcatcgcctgctgcccaccagtcggtcaagttaccgttcttatcgtactgacgaccctggtcatcgaatccgtgagtcatttcatgaccgataactacaccaatagcaccataattgaatgcgtcatcagcgttcatatcgaagaacggatattgcagaataccggcagggaaacagatttcgttagtagaaggattataataagcatttacagtctgcggagtcatcaaccattcatctttgtcgaccggtttgcccagacggctgtacatatcatccaatccccatttgttggcacggcaagcattggcccaataagaatccttcttgatttccagattagaataatccttccatttgtcaggatatcccacttttacatggaaagcagccagtttttcctgagccaccattttggtgctgtcgctcatccattcctgtgcctggatacgttcaccaagagcttcctgcaagttctttaccagcttcaccatacgttccttagctgctgccgggaaatatttctctacatacatctgtccgacagcctcacccaacatactttctacggcaccaacggcacgcttccagcgaggagaattctgctgacgtccagacaatacctttccgtagaaatcgaaacgggcagctacaaaatcatcgctcaggtatgaagctgctgcatccagcaagttatactgcaaataagaaacatgtttagatacaggaagtgtattgatcagtttttctacttctttcaaaggttcgatttgcattacgttcaggtctgtaacttccttaacgcccaaacctttcaaataagtatcccagtcgatgccagcgaatgtcttcttcaaatcagcataagacatcttatgatagttggcttccggatcacgctgctgaacagcactgaaagcttccttggcaatagaagtttcaatttccattacatctgccatcttctgctgagcctcagcttcagagaaaccagccaatgtaaagagtttggcgatatacttcttatagttctcacgtacattgacagtggcactatcattgtcaagataatattccttttcgcccaggttaaatccaccctgactgatctggaacatatttacatcactgtttttcggatcggcatatacaaagcttgagaagtaagtaccgataccgttattcagcaattccaccatcataggaatgatttcgcttttatctttcaaagcagcaatcttatccaattccggcttgataggattcataccctctttattgagggttacactatccattgccatattatacaggtcgccaatcttctgagccagcgtaccctgctgattttgttttgaagccagcccttcgataagttcctgcaattgcttgcggttgttttcaatcagcacttcaaacgttccataacgagaatactcagcagtcagcggatgattcttcatccagcctccacatgcataatgatagaaatcctgacttgcagaaactgttgtgtcaagatttgccaagtcgatgccagaagtactctttgcttccttctgaccggcacagccagtcatagcagcggcaacaagtactgccatagcagcaaaatgttttgttttcataagcgtttataattatagagtttttaatttttaagttcttccaattccaaagaaacattctcccactcttcctcagcatccgaaatctgttttttcagctgctgatgctgttcgtacaatttcatgtcggaagctccctcgggcgtagccatctgagcttccagtgcagcaacctccttttccagacgttcaatcagcgcttcacagtcagcaacctgcttctccagcttacggattttcttgttttgctctttctgcgcctcatacgaaagtttactctcgctggcaggtaccggatcgtccttcttgacagactgagcagttgttggcgactgagagagttgcagatcattgagactttccattttctttttctgcaagaaatcgtaaatgccgccgatgtgttctttcacaactcccccaccgaactcataaacctttgtaaccagtccgtccagaaactcacggtcgtgagaaacaacaataaccgttccgtcaaactcgcggatggcatctttcaatacgtccttggaacgcatatccaggtggttggtaggctcatccagtatcagcagattcaccggttccagcaacagcttaatcattgccagtcggctccgttctcctcccgaaagcactttcaccttcttatcggaagcctctccgccaaacatgaaagcacctaatatatcacgtatttttaaacgtatatctcctttggcaaccgagtcaatcgtatcaaataccgtcagattctcatcgagcaactgtgcctgattctgtgcaaaataaccaatctgcacattatgtcctatcaccagttttccttcgtacggaatctcacccatgatacactttaccaaggtagatttaccttcaccgttctttcctacaaaggcaaccttctcgccccgattgatggtcaaggtcacatcatgaaagacgacatgatcgccgtacgctttctttaccccttcgcagataacaggataattgcccgaacgtatggctggaggaaatttcaaccgcagagcagagttgtcttcttcatcaatttcaatcggaacgatcttctccaactgcttgatacgactctgtacctgtacagcctttgtcgccttgtaacggaaacgttcgataaaatcttctgtatcctttatttctttctgctgattctcataagcgcgcaactgctgttcgcgacgttccttgcggagtacgacaaactcgtcgtaaggcaccttataatcataaattcgtccgcaagaaatctcaatggtccggttggttacattattaataaacgcacggtcgtgacttaccagtactacagcccccggactcattttcaaaaaattctccagccactgaatactttctatatccagatggttggtcggctcgtccagcagcaagacgtccggacggcgcaacagcaactttgccagttcgatacgcatacgccagcctccactgaactcgctggtcggacggtcaaaatcggaacggctgaatcctagtccgacaagcgtacgttctatttccgcccgataattggttcctcccatcatcaggaaacgctcgttatcgtgcgtaaaacgttcaatcagttcatgatagctttccgaatcgtaatccgtacgatcggccagctcctgattcatctttgccagtctgtcctgcaactcaaatatatgttcgaatgccatttccgcctccgccatgacagtacgcgtatcactgagaatcataacctgcggcagataaccgatggtcacccctctctgtacagctacgcttccttcagtaggtttctgcaagccagccagaatcttcaacatggtcgacttacctgcaccgttcttaccaaccagtgcaatacggtctttcttattaatgacaaacgaaacatcctcgaacaaaggagtaactccaaactcaactttcagtccttcaatagaaatcatatattcgctccaactttacaaagtgcaggcaaaggtagtatttatttctcgttaatttatacattttgtgtataaatcagcatcataatacttttactcagagagtaaacaaaaaatccgccgatgaacataaactgtcatcagcggatttttatctatcagaacaaattaatgtccctgaaattattcttctgtatagcgttcaatagtctgctcacggtccggaccaacagaaacaatcttgataggagtaccaagctgttcttcgaggaatgaaatgtaggcgttgaattcttcagggaattcatcttcgcttgtcatcttagtcatatctgtcttccaacccggcatttctacataaacaggttctacaccttcagttatgtcgaacgggaagtaatcgatttcctcgccgtttaccttgtaagccacacaagccttgacggtatcgaagccatcgagcacgtcactcttcatcaagataagctgagttacaccgttaatcatgatagcataacgcaaagcaaccaagtcaacccaaccacaacgacgttcacgaccggttaccgcaccgtattcatgtcccagatcgcgaattgtcttacctgtttcatcgaacaattcagtagggaacggtcctgagccgacacgtgtacagtaagctttcatgataccatatacttcacctattttgttcgggcccagacccagaccggtacaagcaccagcacaaatcgtgttcgaagaagtaacaaacggataagaaccgaagtccacatccagcatggtaccctgagcaccttcgcacaatacactctttccttccttcaacaagttattgatttcatgttcgctgtctaccagatggaactgacgcaagtattcgataccttccatccactgtttttccagttcggtgatatcgtattcatagttcaggctcttcaggatcttttcgtgacgtgctttggcagctgcatatttttcgtcgaagttatgcaggatatcacctacacgcagaccgttacgacttaccttatccgtataagtcgggccgatacccttaccggtagtaccaactttcgaagcacctttagcagcttcgtaagcagcatccaaaatacggtgagtaggcagaatcagatgagctttcttcgaaatgtgcagacgttccttcaacggatgaccgcttgcctccaaagcctcagcttcagccttgaacaaagctggatcgagtaccacaccgtttccgataatattgattttatctccctgaaatattcctgaaggaatagagcggagcacatatttctgaccttcaaattcaagagtatgacctgcgttcggtcctccctgaaaacgagcaacaacatcatagcgcggagtcaacacatcgactactttcccttttccttcgtcgccccattgtaaacctagcaaaacatctactttcatgatttccaacttttatataagtttatttacttttcttacgtttggccaccatacatttattgcacaatccatatatatataaggagtagtgcgaagcatgaaaacctttcagtttcgtttcggctattgcctgcttcaaggtgtcatcttcgaactcggaaacttttccgcacgaagtgcatatcatgtgatgatgggtttcattattatacgaacgttcgtactgtgaagtgttaccaaactgatgtttgatgaccagtccggcatcaatcaggagtatgattgtattataaagagtagcacgacttacacggaatttctctttctcggccatataagaatacagcatgtcaatatcgaaatgcccttttatggtatagatcgtatcgagtatagcataacgctcgggtgtcttgcgatgcccgttcttctgaagataatccgtcagaatctgctttgccttatcttttatattctcttccatccggtaattcgttcagggttcaaagttaatcttttttgcgtaatttagaaaaacaataaaagaaaaatttctttatttgagtcttgcctgagcatcagtattccagatccgcttttatctcttcggccagtgcatgtacggtaggattctccaatttcatccacagtccgagctgcttgcttacgactcttttgctttcgcgcgactgatgtgcaaacttacgcaaggctaccgatgcggctttctgtacctgcatgctgccaccttctatggcggtataagcctgatcgaggaattctgcctctgcacgctcgttcaacttttctcccttcatgagcagacgagccatcagcaggaaaccgcacagctgaaacatttcgcgttcgtccgccatccagcggaatactatttccgaagcgtaaggcaggcgctggaaaagattcatgaccgtatactctgccagctccggataatccattccctctatccagatatcggcaatctcagggtagaacgtgtcgaccggctgaagtaatcctgccatgatcttgcactccctgatattttctttccacaaggcctgcgccagctcatgattgggctcatattcggcagcaatttcctttatacgcggatattcgataccaaagttgagcttataccccattcctttctcacgcatgctttgcgaaatcattccgttcatgaaaagacggaacttcgacttgatatctctgattgtttcgtgtatattgctattctccataataaaaataataaatcctatagcaacagcagtcttatctcacaacaagctcttgctacaggaagatagttataaattagaataatcccggctataccgaagcatctgctcggcatatccttcggtataagaaatctgtacatcgacgatatttcctccggcatcggcctgaggcgtgtagaccggattcaagaagcccttgtaaggtgccagatgcaagctgcggtaacgttgcagtacctcggcatgcaataccggatctacctgtacgccgtatgtttctaccagctgacgtgcggcttcgtaatcgccttcgctcttgatgcgctgtatttctgccagcaacttgccgaacaacgtacgcaacttggcgtaatcgttgatacgtacataggtctttccatcgcgtacaaccatttcgactaccttctcgtcctttccgtgttccaaagcccagcgagcaatcaactggcggttgcgcatgtgcgcctcttctaccgtacatcccggttcaatgcgtacaagctgtgtcatcagtccgttcatcatgtacgaataatattctgccttgtatgcctcagcatcgggaacaagtcccagctccaccatcttggcatcaggcaagtaatacagtccgaacaaatcggcacgtgcttcttcaatcgtcgagccatgagctttcagcgcatcagggtctacgcccggaagcagcttgccggagccgtgtcccagacattcatgcaaatcggtatgcaggtcgtcggttatgtcggcatatttctccagcaactcgcgttcaacatcactgtacacaaactcttcacggaaaccgtttccacgggcagccttgttatacgcatcggtcagattgccgatagtaaccgacttcgatccgtgtacgctgcgaatccagttcgaattcggcagattgataccgatagcagttgacggatacaagtcgcctgccagaatagctgccgtaatcacctttgccgaaacacctttcacctcttctttcttgaaacgagcatctaccggcgaatggtcttcgaaccactgtgcattgctgctgatggtttccgtacggtgagtagcttccatatccttgaaattgacgattgactcccagctggctttcatacccagcgggtcgccatagctttcaataaatccgttgacaaaatctacctgcgaatcggtatctttaagccatgcaatggaataggcatcgaacaccttcaagtcgccgctacggtaaaactcgataagcaaccggataacctcaggctgtgcatcattttcggctacagtttctgccttctccagccagacaatgattttctctattgcagccgaatacataccacctaccttccagacctgttcgtatatacgaccgtccttctttaccagccggctgttcatgccatacatgaccggttccggatcatcggctttcttctgagccgcataaaacgcctcagcctcttgctgggttaccccctcgtaataattggctgccgacgtctgtaccagatcttctccgtctgcctgattcacacgtttgggcatgacggccggatcgaatatcaccggaaacaatttgtcgcacatcgcccgacaggtttcaccttcttcaagcggaagtacttcagctggcagcgactgaatgacctcttccagataagccgccgtaaatcccggtacaaacttgtcgcacgcatagtgatgatgaattccgttcgagaaccatacacgtttcaggtacacttccagtgcacgaaacggttcgctcgtacggtcgccctcaaaatgcgtataaacagcttccagcaaacggcgtatctgtaaattatacttaccattctgatcaaacaaaatatcccttccttccaaagctgcctgcgaaagataatatatcagttgcttctgtcgcaacgacaactgctcgaaaccgggaacccgataacgcaatatctgcaaatcggcaaactgctctacagtgtatgaaaatgaattttctgacatttttctttttaatcttttaaacaaacctccattatctaaataaaaaaagccttaaactaaatgtcattccaaacgcaaagaaaaaagtagtcagaaaaaaactcccccatacctttcttccgtctggaatgacatcccgtttttattgttgctaagtcttctctagttctagttgttatctgttattttccagctttcgccttctatagttattcggtgtttcacctacattcttgtaaaacgctgcatagaacgattgtcgattagcaaaacctaccatcgtactgatttcttccacatttttctctgcataacgcttgtcaatcagcatgtgtaaagcgtctttaatccgatactcgttcaccaggcatgaatagttcattccgaaacgggaattgatgacagccgacaagtaacgggtattagtctttagctctttcgcaagatcttttgctgagtaattcgggtctttgtacttcttctgaagaacaatgatgttcataattttatcatacaattcgtccgccaactcggcgcggatcatgttacggtaaggcgcatctttaatcttcctctcccgaagattatagggccttttctctgaaacccgaccgtttccggtcattaatttgtcctcttctctcatctgtctttttatttagataatggttgtttctacgctataaaacactataattatacaaaattgctaagagtttttgtattttacaacagaaatacgagcttattttcacgttatatcattttttcacatttgaaacaccctacaaataaaagataaacgattatttaaaagattgaactatctttgcccgcaattacataaatataagaaatggtactgaaaacgctgaaatcatatttcggatatactcaattccgaccgcaacaggaagaaatcatcactcaaatattaaataaaaaagacacgctggtactcatgcccaccggaggtggaaaatcaatatgctaccagcttccggcattacttatggaagggactgccattgtagtttctcctcttatctcactgatgaaagatcaggtggagagtttgcaggcaaatggtatcatcgcccgtgccctgaacagcacaaacgacgaaacagccgatgccaacatccgtttcgaatgccggcagggaagagtgaagttactctatatttctcccgaaaggctcctgtcggaaatcaacttcctgctgaaagatatccgtatctcgttgttcgccatcgacgaggcacactgcatttcgcaatggggacacgacttccgtccggaatatacccagttgaaagtgctccgccagcagtttccggatgttccggtggtggcgctgacggctacagccgacaagataacgcggcaggatatcatcaagcaactggccatgagagatccgaaggtcttcatttcttcattcgaccgtcccaacctgagtctggatgtaaaacgtggttaccaacagaaagagaaaatgcgtaccattttcgacttcatcgcccggcatcgcggagaaagtggaattatctactgcatgagccgaaacaagaccgaaaaagtggcggaaatgctagaggagcatggtatctcgacagcggtttatcatgccggactcagtacggctgcacgtgaggcggcacaagatgattttatcaacgaccgtgtacaggtagtctgtgcgacgattgctttcggaatggggatagacaagtcgaatgtccgctgggtcattcactacaacctgcccaaaagtattgaaagtttttatcaggaaataggtcgtgcaggacgcgacggactgcctagcgataccttgctgttttactctttcggcgacattgtcctgctctcgaagttcgcggctgaaagcagccagcaggaaatcaacatggagaaactgcaccgcatgcagcagtatgccgaagccgatatctgccggcgacggattctgctgaactatttcggcgaaacgatggatcacgactgtggcaactgcgatgtctgccgcaatcctcccgaacgtttcgacggtaccatcattgtgcagaaagccttgagtgccatcgcacgtgccgaccagcaggtatctaccaatacgctgattgatattctgaaaggagctgctactcaggaaatcatcgaacggggctacgacaaattgaaaacgtatggtgccggacgggatattccggctcgcgactggcaggactatctgctgcaaatgctgaacttaggatatttcgaagtggcatacaacgaaaagaatcatctgaaaataacggaggctggacgaaaggtgctgttcggacacgaacgtgctttgctggtggtcatcaaacgtgaggattatacagaaaagaaagcaggcaaaaaacgcaagcagtctgccccgaacgatgtcttgttccctacgccaatggtgttcgaaaacgaagacgaacagttgttcgaggaactccgtgtactgcggaaacgactcgccgaccagcaggcgataccggcttatatcgtactttccgacaagacgctccacctgcttgcttcgtcacgccctacgacgatagaggccttcggcgaaataagtggtatcggcgaatataaaagagataaatacggtaaggactttattgaagtcatccggaagtttgtcagatagggaaccaataagtcaattatttttatcaaggtttaatcgatgaacggtagcctgattcaatgttttctgtttctggcttgtactctttctgacacgcctaaaataaacaagcatacattttcaaaaaacgtcggcacattttacaaaaaatatgccgacgttttatctaaaacctctgcacgttttttgaaaatttgtacaaatttccagcaaaggtttaatcatttattattcaatcacttgcatttcttcaatttctccatcagttccaagcggggaatacccaacgaaattgctttttcatatgcttcacttgcctcgtgctttttctccatttgtaaataaatatctcccatcaccacataggtatcagcatcccggttatccaatttcagcgcctcttccaaatcgagcaaagcagcatcgggcaagttctgctccagttccagattagcacgcatcttatacagggaagcatccttcggataatcctcaatcagcaaattcatcccatctcgtgcagcgatgtatcttccttctttctgatccagcatcgccagtcccagacgggcagccttgtgtttggcgtccactcccaatattacattgtagtcgatacgtgcctccttgtactgccgccgtttcatatagatataggcacgaaacagacgagcctccttatcgttcggtagcaggtcgatcacgttgcaatagtccagatacgccttttcggtcagattcttctccatgtaaagagtggcacggttcagcaggatggctgttgcataaggagtaatattcaaagccatggtgtacgcttcgatggcttcgtctatcttcccctgacgtttcagcacggttcccaggttggaaaagagcaaagcattccgggcattgtacgggtcaagccgcagggcttcgcgaaacaattgctcggcctgttgcagactgtccttgaaagtatagtccatcgccttttccaccagctcgttgtacgactgcgcacgaccggttgtcagcaagaggacacctatcaaacatagaagtattcttttcattcaaacacaattttaattaaatctgtaagcaaaggtaatggaataatctgtggggataagtgtatattaaaaagtttttgtaagtttgaacaatcatttaaacagaaactatcatgaaactagaaaaagctatattcgcctgcgggtgtttttggggagcacaataccagttcgaacatgctaaaggagtagtacgctccacagtaggttacatcggcggacacaaggaacatcctgcctacgaagaggtcaaggcacatactaccggacatgccgaagcaacgctggtagaattcgatgccgaacagacatcgtttacagacttatgcaaacttttttttgagattcacgatccggcacagaccgacggacagggtcctgacatcggaccacagtaccgtagtgagattttttatctgaacgaaaaacagaaacaggaagccgaagcggtcattgctctgctgcgtgaaaaaggatacgtggtgaataccaaacttactcctgcctctactttctgggaagcagaagaatatcatcagcactattatgacaagacgggaggagaatcttattgccatatccgcacaaagaaattctgatatttccgatagccagtgtaatcagcgtatatttatacacaatattggataatccaacaaaaaaaagccgttgctgcaaaaattgacagcaacggctttttgttcttatcattcaatttcagcaaccgaaacgaatcaggcttttttgatgtaatcgacaatccatgcacccacttccttggttccatatttaggcttaccctcaacctgaatttcgggagtacgtacacattcgtcgagtgaagcatcgactgccttacgaatcagtgcaccttcctctttcaagtcaaagtattcgaacaacatggcaacggacagaatctgtgccaacggattggcaatgttcagtcccttagcctgtggccatgaaccgtgaataggttcgaacaccggagtgctctcaccggtagaagccgaaggcaacaatcccatagagccgctgatgcaagaaccttcatcggtcaggatatctccgaatgtattttctgtaaccattacatcgaagaaggtaggttcctgaatcatacgcatggcagcgttgtctacaaacatatagtcggtagtcacttctggataagaaggagccatttcctgtgcaatctgacgccacagacgagaagaggccagcacgtttgccttgtcgactaccgtcagatgcttacgacgtttcatggcatattcgaaaccaaccttcaggattcgttcaatttcgggacgagtatacatgttggtatcataagccttgtcgttgtcttggtatttttcgccgaaatacataccaccagtcagctcacggatgcaaaggaagtcggcaccttctaccagttcggcacgtaaaggtgacttatgcaacaggcatttgaatgtctgaaccggacggatattggcaaacaatcccaatttcttacgcatggcgagcaatccctgttccggacgaaccttcgcagtcggatcgttatcaaatttcggatcgcctacagccgagaacaatacagcatcggcgttcttacatatttcataagttgcttccggaaacggatctcccaccttgtcgatggcatccgcaccgcacagcgcatattcgtagcttactttatgtccaaatttctcacacacagccgacatcacgtccacgccctgaacagagatttcaggaccgattccgtcgcctggcaatacagctattttaaaatccatagttctttatttttttgattcttctataatgttaagcattttaattgtcgccttgatagccgcttccgtctggtcggcatcaaagccgcgggtacgaaactccctgtcctcatagttccaggtaatgactgtctgcacaaaggcatccgtacgtccgccgggagggatggtgaccgcatagttcacgagcatcgggaaagtacgtcctaagatgtctttgtaaatcttacgcaacgcacgtacaaaggcatcgtactgtccatcaccggaagaactttcctgataaacctttccgtcgatttcgatactcaaggttgccatcggtttcagtccttttgccagcgtgacaaaataactcagcagtttcaccttattggttgtggtgtcgtgcttcagcacatcggatatgatgtaaggcaaatcttcctgcgtaacctgctccttacggtcgcccaactcgataatgcggtcggtcactttcttcatcgactcctcgtccagctccagtcccaggctttccagattcttccggatattcgccttgccggagttctttcccaacgcatattcacgtattctgccgaaacgttccggaagcagatcgttgcaatacaaattgttcttgttgtccccgtcggcatgtacgccggccacctgcgtaaatacactgtcgcctacaatcggcttattggcagggatggtcacacccgaataagattcaaccagacggctgaccacattcagacgactctcgtcgatattggtaattgcatggaaatgatctttcaagattgcctgcacactggccagcggcgcatttcccgcacgctcacctaaaccgttgatggtagtatgcaatcctttgacaccgctcagcacggctgccagcacattgctcactgcaaggtcgtaatcgttatgcgcatgaaaatcaaaatgcacatcgggataacgcttcttcatcttccgcatatactcgataacctgcaacggattgaggatacccaatgtatcgggcaacataaaacgcttgatgccgcaatctttcaatccgtccatcagtccgaatacataatcgggagaatcttttataccgttactccagtcctcgagatagacattcacatccatgcctttttcatgggcatagctcactacctgccgaatatctgccagatgctgttccaacgtcttcttcagctgaaacttacagtgcttttccgatcctttcgtcagcagattgatcacccggcatcccgcattgtaaatccagtcgacagacacatttccgtcgacaaaccccaacacttctacccgagataacattccccgacgagctgcccagtcgcaaatcatttttactgccttggcttcaccttcggaaacacgagccgaagccacttcgatacggtcgactttcaagtcttccagcagtaaacgggctatcattaatttttcatggggcacaaaggacactccgctggtctgctcaccgtcgcggagtgtggtatccatgatttctattctcggatgattgttcattgaaattgtttaattagttacgagctttttcgtaagcttctattttatctttattttctaccagaaaatcgatgtcgtcgagtccgttcatcaagcaatgtttcttgtaggcattgatttcaaacttttccgacttacctgttgccttattggtaatggtttgttccggtaaattcacttcgacctcagttttcggatcggcataaatagaatcgaacaactctttcaggaaaccttcgcttacgactaccggcaacacgaaattgttcagttcgttatttttatggatatcggcaaagaagctcgatactaccacacggaaaccatatccggcgatggcccatgctgcatgttcacggctggaaccactaccaaagttctttccggctaccagaatctgtccgctgtatgtaggatcgttcagcacaaaatctttgttcagcgagccgtcgggattataacgccagtcgcggaaaaggttatcaccgaagaatttttcatcacgggtagtcgctttcaggaaacgtgccggaataatctggtctgtatccacattttccaatggcaaggggatacaagtactggttatgatgttgaatttctgtttcataataaatgtacaattttacggattacataagtgttctgggatcggttatcacgccggttacggcagcagcagcggctgtcagcgggctggcaagcaaggtacgcgaacccgggccctgacgtccttcgaagtttctgttgctggtagaaaccgaatattttcctgccggaatcttatcgtcgttcatggcaagacaagccgaacatcccggctggcggatttcgaaaccagcttcttccagtatcttgtccaagccttcctgacgaatctgttcgtctaccatccacgatcccggtacaagccatgccgtgatgttttcggctttcttacgtcccttcacgatagaggcaaacgcacggaagtcttcgatacgtccgttggtgcatgctccgaggaacacataatcaactttcttgcccaacagcgattcgcccggctggaagcccatatagtgcaaagacttttcgaacgaacctttctctacatcgctcattccttcggtagtaggaatatgatcggtaatagccatacccatacccggattggttccgtaagtaatcatcggctgaatatcggctgcatcgaaacggacttctttatcgaataccgcatcatcgtcactcttcagcgttttccagtaagcaagtgccttgtcccattcttctcccttcggagcatattcacgtcccttgatgtattcgaaggtaacttcatccggagcaatcatacctccacgagctcccatttcgatactcaggttacacaaggtaagacgtccttccatcgtcaggctgcggatagcctcgcctgcatattcaacaaaatatccagtagcaccacttgttgtcattttcgacatcatgtagagcgctacatctttggctgttacacctttacccagttttccgtcgatagtgatgcgcatggtcttcggacgtgcctgaagaatacactgagaagccataaccatttccacttcactggtaccgataccgaaggcaacagctcccatagctccgtgagtagaagtatgtgagtcgccgcagacgatggtcattcccggcagagtaagtcctctttccggaccaactacatgaatgataccattcttcttgttcatcatgccgaagtgagtcaggccgaaatcagcagcattcttggcaagtgtatccacctgtgtacgagaaataggatcttcaatcggtttgtcctgatcgtgagtcggagtattatggtcgggcatacagtaaatcttttccggacggaaacatttcaatccgcgagcccgcataccagcaaatgcctgaggacttgtcacctcatggcagtaaaggcgatcaatatacaattgagtaggtccttcctctactttctgcactacatgtgcatcccatattttgtcgaataatgtattagccatacttaaaatctcattatattattttctgaatttattgatacaatctatataagcttctacagatgccgcgatgatatcggtatttgctccgaaaccgtaatacatctgtccgtcgtattctacctgcatgtgaactttaccaacatcatcactacccttgctgatagcctgaatggtaaattccttcaaagtcatctggcgcttgataatctgttttacagccttgatggcagcgtctaccggaccattaccggttgcagctgcttcaaagtgctcgccggaaatattcagtcctaagctggcaaccgaacgaactcccacaccactggtcacctgaaggtattccagcttgatgtgatggttcacattgcgatcggctccggcaagtaccagaatatcatcatcagtaatgtctttcttcttgtcggcaagtttcaggaagtcttcgtataccttgtccaacttttcctgattcatttcaacacccagtacatgcagacggtgtttcaatgccgcacgaccactgcgggctgtcagtacaattgcattatcatcgataccgacatctttcggatcgataatttcatacgtctgcacatttttcaagactccatcttgatgaattcccgaagagtgagcaaaagcattgcgtcctacaatagccttgtttggctgaaccggcatgttcatcaggctggaaaccattcggctggtaggataaattttctgcgtattaatattggtatcgatgtcaatgccgtgatggcaacgtaaaatcatggcaacttcttccaaggctgtatttccggcacgctcgccgataccattgatggttacttctacctgacgggcaccgttcaatactccactgatggtattggctgttgccatgcccaaatcgttatgacagtgcgtagaaatgattgccttgtcgattccgtctacatgatctatcaagtatttgatcttggcaccatactcgtcgggcaagcaatatccagttgtatcgggaatatttactactgtagctcctgccttgataacagcctctatgacacgagccagatattcattttctgtacgtccggcatcttctgcatagaactcaacgtcttctacatacttcttagcatatttcacggctgctaccgcgcgttcgatgatttcttcacgagtggaattaaatttatacttgatatgaggatctgaagttccgatacccgtatgaatgcgtttgtgttttgcatactgcaatgcttcggcagccacatcgatgtctttctgtacggcacgtgtcaaagcacagatggtaggccaggttactgctttcgaaatttcgattacagaattgaaatctcccgggctggaaataggaaagcccgcctcaattacgtctactcccaaagcttcgagctgctttgctacctgaattttctcgactgtattcaactggcaaccgggaacctgttccccgtcacgcaatgtcgtatcaaaaataaataatctgtcgctcataaacgtatatcttttatattgttttattcaagcaaaaagcctttcgcaccagaagtgagaaaggctttatatcataaatcttataccgtcatgcacacggctcactttccactggttgcaccaatagaataataataccgcctagcaaaatatgtataagaaatgtactcattattatcttttatttgtcttaaacgcttgcaaaggtagataatatttcgacattacaaaataaaatgaaagttttttattcatttcagcaacaaattagtatttggcaggctattttaagcgtaattcatacagacaagcttccacttctgcattacttcccatgtgttttcccatatcatctgacaatttaacacattctcgccattcctggttaacattcatcttacaacgcgacaatttcataacaatatttgaaggctgatatcctgtatcgttggtaaggtttgtccctataccgaaggaacaacgtatcttacctttgcagtaatcgaatatatgcaacgccttctcaaagtcgagtgcattgctgaaaataattgttttcgtctgcggatcgatacctaattctttgtaacgagctattaaccggtcgatgaattcaaattcatcacctgaatcacatcgtacaccgtcgaagagcttggcttgcttacgactgaagtttgacaagaaggaatccgatgtataggtatcggaaagggctgtacccaaatcaccgtcgtacacatttacccagttttccaacgccatgtaattggcatgcttatagccgaactgagctccatggaacatgaaccattcgtgcggatgggttcccattggacgcatgtcgtatttcatggcgagataacagttcgacgtaccggtacaatagcgggcatgctctttcagataggccacaacaatatcgtgtacatccagagagaagcgccggcgagtgccgaattcagaaaaaggcatatgatgttcgtttgacaatttcacctttcctgccagtttgcctatgattgattctttatccggtattctatttaaaaactggtttttgatttcggaaacaatcgccaacaacggaacttcatataatgttaccttgtataaataatcggtcacttcgatatgtaaatgatgctgctcgtccagactcacagctattttgtcaggatcaaaacggaaagaagacagccattcccaataaacacgcggcaggaaccggcaatgagaagacatgtactccagttcttccttgcggagcgaaaccagtgacaaattatgaatctcatttttcagggcttccagaaagccttctgtgtattctgtttcatctctatccttaaaagtaaatgttcctaacgcataaggaaaaagcttgatataagcgtacgaagttgtaaacttatacaaatctgtatctaaaatcgtttttattaccatagcattgtttttatttctttttgtaaatataaggaagaaaaattacttcccattattctgacaagatttttacttcaatttcaatgctacgatacaatctgccgacggttccaaagtcgcagtatgcaagacaattcctccatcaattttctcccattttactttttctccagaagcaaacaaggtggcagatacgactttttcggttaacggcaaagtaacaaattgaggcatcttatcggttagcagatgtacatacagcatatctcctttacgggtagtagttccccacgaagcagttaccacattccccgaagtcgatccgtaaatggtttctccatttttcgccatccactctcctattccctttaatcgttctacggcaacagcaggtaactctccgttgggctgaggaccgatattcatcaacaaattggcacccttaccggcagcacgtaccaacaggcgtatcagctcggtgaccgatttataattttggtctttaatcttgtacccccacataccattcatcgtttcacaagtttccaatggcaatgcactgatagactgtccagacaatcctgcggtattctctccgggtagatcgcgttcaaacatttgaaaatcctcacccgggaaaggcgttttatgatggttatttccaatcaaacaagcgggctgcaatttatgaatcaaagcatattgttccttcagtccccaattgaaatcatcaggctgatcccacagtccatcgaaccagattgcccctatcggaccataattggtcaacaattccgtcaactgattattcatgaactgataatatgtactccactctccatgagatttacgtccggttccgcgtccggttcttcctaaaggataataatcttcacgcgtccaatccagatgggaataatataaatgtagtttgataccctgtttctggcactcctcggccaactctttgataatatcccgcttaaacggagtagcgtccactatattataatcagaatatttagtgtcaaacatcgagaatccttcgtgatgccgggaagtaaaacagatatattttgctcccgaagccttaatagccgcaacccaatcgtgtgcattgaatcgagaaggataaaaaccggatgccgctttcgcatattcatgacagtcaatattctcattagtcatataccattctccctgtccgaacatactataaagtccccaatgaaggaatataccaaatttactatcctgaaactccttgcgtgcctgcaaattctctggtgcgggtacatactctgttcccgaattctgtgcatagagggaagatattcctaaaagcccacttaaacaaatagtctgccaaaaacgaaaaatacgtgttttcatacttacccgataattaaaaaaagaataattagatttattttttcaaagatacaataaaaaatcgagtttcatcgtagaagctttttgaaagcggggaatcaatttcggaaagatagtacgacattcagctgtttacccatcaagtacaactatgcttttaagacattctccaagcaatgaagcatatttttatgtatctcaattgtatgcagacccaatcttttacttgatacaaaaaactcagcctggcgggcgcatgcctgaagccgactcatccgatgtaaagaaaagagtatccgcactccagccaccggtacgtcccgccgcaagcaggcacaaaaaattccaagaaacaaattctatcagattgtttaatcgagtatgtccctgtgtcagcccgtcgcgtccgggcataaaaagaggtcccgcagcgtcgttgctgcaggacctcttcaagacggcgactacctactctcccacttgcgcagtaccatcggcgtgacgaagcttaacttctctgttcggaatgggaagaggtggaaccttcgtgccatagtcacctgaatatcgttttatgtattcatgactcacaagcaagcaattccagcacttgtttcaaagctgaaagtatatatcatccatccttatttcaaggaaagtgaacgggcaattagtaatgctcggctttggtgtctccacctttacacctgcatcctatcaacgtcatcgtctttgacgaccctgagaaatctaatcttgtggccggcttcgtacttagatgctttcagcacttatccgatcccgacttagatacccggcgatgcacctggcggcacaaccggtaaaccagaggtcggtccaacacggtcctctcgtactagtgtcagagccacgcaaatttcatacgcccacgatagatagagaccgaactgtctcacgacgttctgaacccagctcgcgtgccactttaatgggcgaacagcccaacccttgggaccttctccagccccaggatgtgacgagccgacatcgaggtgccaaaccactccgtcgatatgagctcttgggagggatcagcctgttatccccggagtaccttttatcctttgagcgatgtcccttccatacggaaacaccggatcactatgctctagtttcctacctgctcgacctgtctgtctcccagtcaagcgcccttttgccattacactctgcggacggttaccgatcgtcctgagggcacctttagaagcctccgttacgcttttggaggcgaccaccccagtcaaactacccaccaagcaatgtcctccatccgggagttagaattcaaacaaacaaagggtcgtatttcaacagcggctccacaaacactggcgtgcctgcttcattgcctccgacctatcctacacatcgcgtgcccaaattcaatgctaagctatagtaaaggttcacggggtcttttcgtcccatcgcgggtaatcggcatcttcaccgatactacaatttcactgagctcacggttgagacagcgtccggatcattacaccattcgtgcaggtcggaacttacccgacaaggaatttcgctaccttaggaccgttatagttacggccgccgtttactggggcttcaattcaatgcttctcttgcgatgacatctcctcttaaccttccagcaccgggcaggtgtcaggctgtatacttctactttcatattcgcacagccctgtgtttttgttaaacagttgcctggacctattctctgcgccctctcttgcgaggagggaccctttatcccgaagttacagggtcagtttgcctagttccttaaccgtgattcactcaagcgccttagtatattcaacccgactacgtgtgtccgtttgcggtacgggtaccatggaagttatgtttagcggattttctcggcagtctgcttacctgcgctgttggattgtcccggaggacgctccatactgtcaagttcggctcttcccgcggatttgcctgcgggaatcagcacctacactctttaacgggctattccgtcagcccgcggcagtgtcacttctgcttctccacgtcaccctccaaggtagtaacggaatattaaccgtttctgccatcggcctcgccgttcggctgagccttaggacccgactgaccctgatccgattagcgttgatcaggaaaccttagtctttcggcgagggggtttctcaccccctttatcgttacttatacctacatttgcttttccatacgctccagagtacctcgcggtacgccttcgacgccgaatggaatgctcccctaccaaccattgctggttccacggcttcggtagacaacttatacccgattattatccatgcccgattcctcgactagtgagctgttacgcactctttaaatgaatggctgcttccaagccaacatcctagctgtcttagcaatcagacttcgttagtttaacttagctgtcatttcgggaccttagccggtggtccggattcttctcctctcgggcacggaccttagcacccatgccctcactcccggggtaaaactgatgcgcattcggagtttgtcaggacttgataggcggtgaagccctcgcatccaatcagtcgctctacctcacatcagtaatccacgaggctgcacctaaatgcatttcggggagtacgagctatctccaagtttgattagcctttcacccctaccctcagctcatccagaagcttttcaacgcttattggtgcggacctccatctggtgttacccagacttcatcctggccaagggtagatcacttggtttcgcgtctgccgccgctgactcgacgccctgttcagactcgctttcgcttcggctgcgggactcgtgtcccttaaccttgccaacgacggcaactcgtaggttcattatgcaaaaggcacgccgtcactccgttaggagctccgaccgcttgtaggcgcacggtttcaggtactatttcactcttctgttcgaagtgcttttcacctttccctcacggtactggtccactatcggtctctcgggagtatttagccttgccggatggtcccggcagattcacgcagaattcctcgtgttccgcgctactcaggataccgctatgcttcgtcttgcttcgaataccgggctgtcaccgtcttcggccgaactttccagatcgttcttctcgcaagatttcttgcaacgacgcggtcctacaaccccacctgtgccgtaacaccggtggtttaggctcttccccgttcgctcgccactactgggggaatcattgttattttcttttcctgcaggtactaagatgtttcagttccctgcgttagccccttactgtgtaaggtaatacctcttcaaggtattgggttgtcccattcggagattcacggatcaggggttatttgcacctccccgtgacttatcgcagcttatcacgtccttcatcgcctccgagagccaaggcatccgccatgcgcccttctttactttccttatcgttcacaccatttttcaacagtgcgggatgatatatacttttagctttcgtactaaaattactttttgcttgttacatcatgtcatagacctatttttctatagtggagaataacggattcgaaccgttgaccccctgcgtgcaaagcaggtgctctagccagctgagctaatcccccgtttttttgcggctgcaaaggtaagcatttactttcgcttgagcaaatttttaaggaagttttttcttcgctccctttcctcgaggtagtcccaggcagagttgaactgccgacctctacattatcagtgtagcgctctaaccaactgagctataggactagcttgcgtgattcagttcaacctcgtctgtttcctgactcggcttcatctttctctctttatttcgttaaacaaactcgcatgcagcacaagaccgaaaggaccttcactcggtcacgctccagaaaggaggtgttccagccgcaccttccggtacggctaccttgttacgacttagccccaattaccggttttaccctagggcgctccttgcggttacgcacttcaggtactcccggctttcatggcttgacgggcggtgtgtacaaggcccgggaacgtattcaccgcgccgtggctgatgcgcgattactagcgaatccagcttcgtggagtcgggttgcagactccagtccgaactgagagaggctttggagattggcatcccgtcgccgggtagctgccttctgtacctcccattgtaacacgtgtgtagccccggacgtaagggccgtgctgatttgacgtcatccccaccttcctcgcatcttacgatggcagtctggccagagtcctcagcgttacctgctagtaactggccacgagggttgcgctcgttatggcacttaagccgacacctcacggcacgagctgacgacaaccatgcagcaccttcacagacgccttgcggcttacctgtttccaagtaattcgtctgcaatttaagcccgggtaaggttcctcgcgtatcatcgaattaaaccacatgttcctccgcttgtgcgggcccccgtcaattcctttgagtttcaccgttgccggcgtactccccaggtgggatacttaatgctttcgcttggccgctgacagtatatcgccaacagcgagtatccatcgtttaccgtgtggactaccagggtatctaatcctgtttgatacccacactttcgagcctcaacgtcagttacagcttagcaggctgccttcgcaatcggggttcttcgtgatatctatgcatttcaccgctacaccacgaattccgcctgcctcaactgcactcaagggaaccagtatcaactgcaattttacggttgagccgcaaactttcacaactgacttaatcccccgtctgcgctccctttaaacccaataaatccggataacgctcgcatcctccgtattaccgcggctgctggcacggagttagccgatgcttattcatacggtacatgcaaaggcccacacgtggaccactttattcccgtataaaagaagtttacaatccataggaccttcatccttcacgctacttggctggttcaggctcgcgcccattgaccaatattcctcactgctgcctcccgtaggagtttggaccgtgtctcagttccaatgtgggggaccttcctctcagaacccctatccatcgtcggctaggtgggccgttaccccgcctactacctaatggaacgcatccccatcgcttaccgataaatctttaatcttaattacatgtgtgcttaagataccatcaggcattaatctttctttcgaaaggctattcctgagtaagcgggaggttggatacgtgttactcacccgtgcgccggtcgccatcaaacttagcaagctaagttcatgctgcccctcgacttgcatgtgttaagcctgtagctagcgttcatcctgagccaggatcaaactcttcattgtaaaatatctttttactcttgcgagtacttttgtctctgttcaggtaaccgaatgtctttactttgttcaaatattgacggttctttctttttcaccgcatatacattattatatatgacagctacttcttgtactacatcttcgtttgtttatctaaagtctttcaaagaactatttcctttttttgtggcttccgttcgttgtcgaaagcgtttgcaaagttaggagcttttttcgaaaccgccaaactttttcgaaagttttttttcaaaaagttttttttagcggcggaagttgactccgtccggctgccgttctcgctcccttaacgccgttaaggtaagatacttggaccgcctcagaaccgctgcttcctgctccgtttcctttcagattgtcatctcttcaacgtctttccctctcgaaagcgggtgcaaaattacgcactttttcgctttctccaacttttacccacactttttttcaatttttttgcaagaaaattcataaaatactgtgtatcaggtatgttttacggcaggttttgcggaatgaggaaaaggaagctgggaggggtactcaatatattattacgcacgtgcaggtgcgcgcgagtctggttcgtgcgaaaaagatccggaacggtgaaaattcctgccggatgggacgaaaaatattctggaaggatggaattctttatcggatgacacgaaaaaaatccggaaatactccccgaggaagggaaaaatggatcatccgcaagggaaattcatgctgaaaaaagcggatttttcttttgaaaaaattcaggagaagcgcaaaaaatatcgaaacgggcagaaaaatttctcagtttccccacgaaaaaaacttgaaaaatatccggattgtcaggaaagacatgcctgaaaacccgatgacagaaacaaaaaaaaagcagatttttcttttgaaaaagttccgagaaagcaaaaaaattatggaaacagacagaaaattttctcagctccacataaaaaggcaggaaaaattatcccgacgaagcgaaaaaatctcagaaaacggatgatccggatgaaaaaaagcagcagatttttcgtaggcggaaggaaaaatgcagaaaaggatgcgaggcaggacagaaaaatctgccgaagcatctgaaaaaatatgaaaatacccagacgaaaagagaaaagatacatttccggaaagatggttcattctgaaaaaatagattttttatcaaaagaatacggagaaaaagacagactgatggaaaagaaacaagagaatcataaccgacaaggtagaaaaacactcttaaaaaacggaaaggtaaatgagagaaacggactcttccaccggaaaagtcaagagaaaaaagcaaaaaaatccgcagtctaaataaaaaatacgggagattctgaaaaaacatgccggaattttctccggtttttgtacaaaaaatattttgttttgtacaaattccgaaaagttttgtacaaaaacatgagacagtagcgggaaaagccgaaggaaatatagaagattttttctcaaagcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaagctggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgctcaaagcaaactcaaataataaaacctaaacaagaaataaaggaaccgttccaccaaaagaataaaacttttagttctacaacagtcattacccttatataaagataggtatttagtccaaacaagctgcatatagtaagaattggaaataaggtattccagcactgaaccaatcgttatcttcatggaatacgaaaccgtaatgcaaaccgcatccgttcttaataagtcagatttctacaatttcatcttcagacagacacttgataatcagatacatttaaaatatcaaagcaacaaaaaaaacaatttaaaggtttgacgcagttcaatttacgttatatagaatataaaagcatcacctcctcccccacactattaataagactacccttttgccacttatgtattctaaaataatcgctaatattaaagactatttctttctacaacattctatcatcttttaaagtctcagtttcacaaatagatattaagtaaaagttgaaagacataaatatccaacaaatacacaaaaacattttatatcaacatacaaaataatttattttattaaatcatagcaaaaagagatagaataaaacagactcaaatccctataaaacaagatattaatattaatttagatttatttagccttaaaaaaacattattacaaatagaaactaaagaatcaacgcaatgcatctatttttaaaaattttcaaataaaattatacaaaatattgctttattaatatattttctatacgtttgcgtttaaaattctacaataactataagctatgaagttaaagaaatcctcttattattgcttatcgcaagcaacccctcctctcaaaaactggttgcacagcaacaagcttcgttatctggttttagccgcaagtgtatttccaatgctaggtacacagctatatgcaaccacagataatagtctgaaccaaacgactcaatcagctcagacgaataaagtaacttaccacggtactgttatagacgaaaatggcgatccattgccaggagtaaacatcacctataaaaatgcaaaaggtgtgggcgtcattacagatgttgacggtaatttcacccttgcagttcctacaaatgtacactctcttattttttcctatgtaggaatgaaaacacagactgtacgtatatccagcccctcagaaaaagtgaaagtgcgtatggaacccgatgccttagctattcaggaaaccgtcatcaccggtatctatacccgaaaagctgagagcttcaccggatctatggctacttattcggaaaaggaactgaaaacggtcggcaaccagaacgtgctgcaaagcttgaaagttcttgatccgtcgttcatcgtgctggaaaacaacctgtccggatctgacccgaacgccaccatgaacctgaacattggaggtaataccaatatcgtgggactggaaacggaatataccaccaacccgaaccaaccgcttttcattctggatggatttgaaacaactctgtctaccattaccgacttgagtatggaccgagtagcaagtatcaccatcttgaaggatgccgcgtctaccgccatctacggtgcgaaggctgccaatggcgtagtagtagtagaaaccaaaaaaccggaagccggaagattacaattcaactacaacggtaactttggtctggaatgggccgacctgaccgactataacctgatgaactcttccgaaaaacttcaatatgaaaagcttgccggatattacggatcactggacgccaacggaaacattatcgatgaatattaccagaacctgtacaaccagcgtatgctgagaaccaaacagggtattgactcatactggatgaacgaaccgttgcaaaccggcttcacccaaagccacaacatctttgccgaaggtggtgatgctgcattccgctatggtattggtatgacctacacacaaactcaaggtgtcatgaaaaattctaaccgtgacgtcttgaatggaaacgtacagttgacataccgtatcgataaattcgcgtttacaaaccagaccaatatcacaaataccgatgtagaaaatccgacggtttcgttcagtgatttcgcccgcaccaacccgttctatgataaatacaatgaatacggagaaatagaccaggttattgaagaaatccaaacaatcagcggcggtacacaatatattactaacccgctatgggacttgaaccagaagagttacgacagaaacaaccagttgtcgtttaccaataacttccagatagaataccgtccgcttccggaattacgtatccgaggcaagctgggtatcatcgtaggacgaagcaattccaagcagttcgattctccggaaatgagtaagtatctgaataccgaccaactgaaacgaggaagttactcagaatcgaacaccaaatcgtcttcatacgatggaagccttgacatatcatacggaaagacattcggcaaacataccataaatgccattggtggtatgcagattagtgaaaacaactccaatctgtctatgttccaagctatcggatattccagcgacttgttctcaaatccgaactttgccaatggttatccagaaggtggaagaccaagctcttcgatttccaaatcgagaacagccagctactatgctaacttcaactacggttatcagttgagatacttgttggacttcaacttacgtaccgatggttcttctgtatatggagtaaacaatccgttctctactacctggtcattaggtttaggatggaacatccacaacgaagaattcttcaataagaatggcgttctcaattacttgaaactgagatactcagtcggtaacccgggaaatgccaacctgagcgccaagatggccaacagtatttatacatactacacatagtatccaaacatgttcggtctggcagccctgatcagttcatggggtaacagcggattgaaatggcagcgtaccaacgaacacaacgtgggtgttgatatcgaaatgttccacaaccgtctgcgtttgagtaccgatttctttatcaagaaaaccgacccgttgttgctgagcatcgacttcccgccttctacaggtatctcacaagtaccgatgaacatcggagccatgaaaaatattggtactactttcacgggtagttatatcatcatccggaaaccggatatgaactggacagtgaatgccaacttgcgccacatccgtacaacttattacaacatcggcgacttgctggaaaaatacaatgaaaaaggacgtaccaaccagaccctgacacgatactatgacggagccagcaacacagccctttacgctgtccgctcagcaggtatcgacccgatgaccggtaatgaaatctttatccgcaaagacggttcgtataccttcaaatgggattcggccgatgaagtaatctgcggagattctactccagacgttgaaggtgcattcggtacaagcttctactggaaaggcttctctgtcaatgccattttcagctaccgttacggaggtcaggctttcctttctaccctcttcaacaaagtagaaaacatcagcgacgtacaggtaaagtacaatcaggacaaacgtgcactttacgacagatggcaaaagccgggagatattgctaagtttaaacgtatcgacgatacaagtactacgaacatgtcatcacgcttcattgccgatgacaatacactggaactctctaccgtttctgttggttacgaaaccacagccggaaaatggttgcagtctatcggtgcttcatcattcaacgtacgtatatacggcaataacctgttccgcttgtcaacaatcaaggaagaacgaggtatcgactatccgttctccagaagaatttcagcctctgtcggcatccgtttctaattataaaaattaccattatgaaaataaagaacttactgaaaaatctactattaataacagctatcagcttcaccacttcttcttgtgccgactggttgaaagtggatatggaagatggtatcatggaagacaagctgtatagcgaaaatgagggattctttaccgtactgaacggtatatacagcagtatgaaccagacttacggctctacgctatcgatgggagtgattgatgtgatggcacaatattacaatgtacctgccaacggtacacatccctataaagtatatgccaactacgactatcaggataaatcattcgaaagtacttccagctcgctctggcagagcacataccaaatgatagccaacattaacgtactgatagatcattgtgatgctccgcagagtgcactttcttcacgttactacccgattgtaaaaggagaagcacttgccctgcgtgccatgttacacttcgatttactcagactgtatggtcctatttactctgccgaaactgaatcgagccaggctatcccctatctggatatccccaacaacaaagacatcatgcctattctttctgccaaggaagtatgtgacaagattctgcaggacttgaaagacgcatccgatttgctgaaggatgatccgattcgtacagcaggcgtacaggctgacgacacaggcgaacagcctctcaacaatcaagataatcctaccttccttcgcaaccgccagtaccgactgaattactacgctgtgcaaggattgctggcacgtctttacatgtggatgggaaacaagaccgaagcctataactgcgtaagccaactgctgaatgagattacgcttaatcaaacattcccatgggtaaccagagctgcagctacctctacttccgcccccgacagagtattctctaccgaggttatgtttggtctctacaacaccagccgcggcaacttgttcgacgcactgttctcacagagtctggaaggtaatgcgcttactttcgtaggaggcttgtcgggcgacgactccaaactgactcagttctacggtacaaacagcagcagtgactaccgccgcagaatgtgggaagaagtagtaaccagcaccgatagcgaaggaacagaaggaggaggagtaagtaccagcatcacttattcattgaaatacgaacaggttagcacagattcctatttcaagtcaatgattccacttatgcgtatcagtgaaatgtacctgatcttagctgaatgtaccaacgacttgcaagaagctcaggatgccctgcaccagattcgctggaaccgtaacctgactgcggacgaagaagtaacagccgacaataaagaccagctcattacagatgagtttgcacgcgaagtcatcggcgaaggacagttattcttctactacaagcgtcatgccatggaagaattcgcatccggaactgatgcaaccagcacttacaagatgttactctctaattatgtagtacctctgccaaagagtgaaacagacaacagacaataaaattttatcgtatgaaaaaactattgacttatatatgtatgctggcgtttgccgcatctttcacttcctgtgaaaaagaaatcatggactacgaaggcgtagacggactgtatttcgatgtccgctggggtaaagatttccgatctcccgaccaatgggcacaccagtactatacgccggtagaattcggtgcgatgactgccaacacctataccgcacaagtgcgtgtaactaccagtggtaccatcaaggattacgatcgcccgttcagcattaccatcggcaaagatagtaccgacgctgttgctggaagagattatgtagatttttccaaagactatgttatcaaggcgggagaacgttatgcttatatcgatattactttcaatcgtacgccggaaatggtagacgataccctgacactgcaactgaagctggaacccaacgaatacttctcctgcccttttaccaactacgaggacaatccgaagtatgaccttccggaaacattctatggttacaaccacgatgcaacttaccacaagatcgttgtcaacgacgtaatggtacgtcctgacggatggtggggacagaacggtttaggaagtttcggaagcttctcacgtaagaaatggctgctgatgatggagatttcaaataccaccgtagaagattatgcagatatgaccatcatgccgatgggacgtgcaggagccattgcagaagcacttgcccggtacttgctggaacaagctaagaaaggaagagaatatgcagttctggaagacgacggtaccatgatgcactgtcctaccgtcaacaccatcgacccgaatgcatggaaatacggagatactcccgacgattactataacaaataataattttaaaaacaggattttactatgaagctaactcatatattatatccagccatgttcggctgccttttaagcctctactcgtgtgtggaagacaaaggctcgtacgatcatcttccggtaaacgaaattaccgttacgggtacagaaaaaacatattctgtgctggctggtatcacagaactgacaatcgaaccgacgataaccggaactatattgggagatgatgacagccagtacgaatatacctggtatgcctgtcaaacagatttgggaagtgaccagcatacccataccgtactcgggcatgagaaaaacctgaaaacaaccgtagtcatgaatccgggaagctacagcctgtacctgattatcaaagacaattccaccggaatggaatggattatatcagatatgacactgcaagtcagcacttcactgactaccggtttctacgtaatgggtgaaaaagaagacggagtaattggtatagacttcctgagcatgccgaacagcgtaggcgatacgaccatgatacacgatatctttactaactcagaaaaacttacagggccgaaagatctgttgtatacaggcgatatcagcctcgcgtcaagacctgtaaacttgtggctgattaccgaaaccggttcttacaaactggaaaactccattcaggaaaagaccatcttcgatattgataagacttataacgaagccttcactttcccatctcagctcatcaagcacccggcgaaagtactcgatcagttcccgcaccagggaatatacggaagagcatacgatataagcaaccgtggtttcattacggaagatggagtttttgcaagcagtatcatttccggagaaatctttgcaagtccgatcaaccgttacgatgcagctactaccaacctcttcaagccttaccctctgggattctgtaatccttacggaagaatgagtgccgtagtattctatgatatggattcagaatgctttgtatacctgaaaaacatgtatactaaatactgtagcaaactgactgaaacggcaggagccttctcctggcaacagaccaaccgtaccatcgtatatggagaaaataatccgatatacagctttgcgctgatgaagagtacggaaaacaatacggattactatatctatcagatgaccattaactattcaactgtaaccaagaacaatgcctatagcttcactactgccgacgctccagacatcgacaaggctacattctatagtttcccttacgaatatcctgtcatgatttatacagtaggcaacaaactgtatcagttcaactacgaaacgaaagtatgcaaggtagtgaagacttattcaggagaaatcacttatgcaagtttcgaatggcaatcacgtggtgacttggacattgtagtctgcacctacgatccagctgcagaagctgataagagaggaactatctacaaatacaccatgggacaggatctgaatatcgaacctatcatgacaggtgtagctctggataaagagtttgtatattatactccgctcaagataaagaagatagaatatcgaaacagctcaagataacttaactcattttgagagattgccggaagccaatttacattctagcgaaagagaaataagtactccggcaatctcttttcgtacaatcaaactattattcaattcatctatttattcttatgaaaaaaacactttcatcaattctgttgggtctgacactggcaaccggtgctgttacagctcagactaatttccgcagcattgatttcaacgaagctctcaaacagtcgcaagccgaaaacaagcttgtattcatcgatttctatactgactggtgcggtccttgccgtaaaatgtcgaaagaagtatttccccagaaacaagtgggcgattacttcaacgctcaatttgtctgcatcaagctgaatgccgaaaaagaaggaaaagaactggctcagaagttcgaggtaaaggcctatcctaccttcatcattgccgaccagcaagggaatacaaaagcaactatcaccggagcttttcctgccgacgcatttgtagctaaagtaaaaaacgaactgaatccggaaatggctcccgaacgcatgaagcaacgctatgaaagtggtgaaagaaccccagaactggtagatgcctatgccatgtcgttcatggaacagaaaaagatggatgagggttacaaaataattgatgattatttcaattcactcagtgacaaacaaaaacttgcacccgaaaacctattcgttttcacacgctacacgttcgatgtttccgatccgaaatgtcaattctggactaagaatgttgaaaaggcagacagcaagacaaaagaaatagcactggctcatcttcagaagctctatcactcggcaacttcgacttatctttcgggctatgtctttgcagaaaacaaattcaatgaggcagaataccagcaactcaagcaagatatctattcgctgaaactggatcagaaatatccgtttgctcctgtattcgagttgatagaatgctatgccaagggagacaagaaagcctatttcgaaatgtttaagcagaaaaaatcagaactcgactcacaagatttcgaactcatcctactcaacgtttcacgtttgttccccaattcaccggaactgatgcctgaagtaatcaaatatgtcagagcttcacttcctgaattacgtggttcttccatcatgatgctgggacgtgtgctgatgaacttggaaaagaactaacagattaatctacatttttattgagagaggttttgctccttgcgaagcctctcttttttgtataagcacttaacaagagacttccagacatatgggcataaaaaaaggagtaccgctgtactccaacctttgttaaccttaaatctaatactatgaaaaacacaatgcaaagatacggactatctcgttattagcaaacaaatgaccaagaaaatcgtgttttacaacataaattaagaaaagggacaaaatctgtaacagtgttttacaaattcaaaagaaaagactgagctcccaacttcagcatatacctatattcaggaactcagtctatcaaaagagaggaaataatacgtttaaaagccttatttcaccgttacttcatcaataaagaaccatgaaggatgacctactccataatgccagggaggacataccttggtacccgtcacttccactttcaggtatcgtgcctgtaaaggagtatccgattcagctttcacccctctgaaaagcacctttcctgaacgttcctccggcatatcaattgttttccatgcctgataattatcgccatctgtcgaataactatacgatacgctcaacgggaaaagaacccaggctcctatctggtgaaggaaatctgtttcaatgcttcttacctccttcacttcgcctaagtcgagaacaaaagctccgtcagtaccttcccatccaacccagctctctacgaaaccggcacccccgaacaatccgtcggtcaatgctgtttcacctaatttctcgtaacgttcgtgaggacgctgcaaccagataactttagctccttttgccaaattgacattttctttcggcaaataacgctcacgatacaacttgcaataatccaatgcgtgattgttacgctcattcaacatcggatcgcccatacgtttggcttcctgttcaaaataatccagtttttgcgttacagccgtcaaatctttctcggtttccgtacgcaacagctccagttcggaataaagcaacggcattcgtgctctctttacccgctccagtaagacagtatcactgctgactgcagcttcagcctcatcaaacagtttctgataccgtctcatcaatgccggacgcagcataccgttcttgtgagaaacaggagaatcgtaaatccacaagcgctgaccactacccagtaaggctccttccataatctttatgtaacgatataagtaatcgccggctgcaccataatatccgttcaggaaatgtttcatcagcttatcaacatctgcatcgggattccacatcagtttagaaacaagatacgatctcagttcggcaaaatctccgcaccagttacctgcaatctgagagaaatgcatctttacatgatgatcgcgaaatgtacgtatattgtcttggagaatatgaaaatttgggaacggtgataaataattatcgaaattgataccataatcccagacgaagagattgtctgcaatagtagaccatccttccagcgctttcataaactgacgcccgctggcattttctgtcaatgaaacctcacggtcacaatcaatgtcgcataacatgaccgtcacattgggcagcggcttgatgtgctttggaggattcatggtatacaggtaagcaagtgttgcaaactccttgtccggaaaacgtgcagccagtttattcaggaaataaatcatggaacccgacaatgccccttcttcctcatctatcttccgacaattttcgcacgtgcaattggtataattgccatcattctggcttacacaaatcagtttcttatcgggattcgccttgaagattgaatcaatacgctgagaaacgatctcgaagacttccggatttgtcagacaccactgacttgcttttcccggatttcgcttgccgttgaagtaagcataatattccggatgcttctctccataaacttctgccggaagtagcttatcgaatgtatgtacccagtatccggcagcaaatgcttcttctggctcttccagccgattccaccacttataaatagaatcatttttcatggcgtaacactgtgtctgccggtatcggaaaaccggattgtctaccttttcaatcaacggcaatgaaatattctccgatttagtcagcgagtattcattctccccccagtaatctattcctaaataatcttccagcaaagatactgcaccataaaccactccattcgccttacccgaaatcttcaagattcctccggcagtagacaaagcgtacccgtcttctttcacatccatcggcgcttcagaaccgataattacatcgcctttccttgccgttttattcgtaaccacaggcatatctgcccccgaaatacgttctacaaacaagcgcagtatgtttgctgctgtacggttcacccttgaatcttgttgtaaaataatgatcgatttcgtttttccatccttcactaaatcgacttgtgcctcggccggcaaacaaactgaagccagcagtgcacctaatgcaaacgttgaaaaatgtcccaatgttttcataaatatttagataaaaaagaaggcgacagaccttataggtagcgccttccatgttgtatttatttctttcttccccatcaaaacgctcattatgcattcttccggaaaggaggcttaaccacttgagctttcaggtggcgcccgcggttatccagataaatttctgtacccggcttagcaaacgctgtctgcacatatcccagtccgataccaatcttacgggtaggcgacatggtacccgaagtaacatgcccgatggtatttccttctgcatccagcaaagcatagccctgacgaggaatacctcggtctatcatctcaaaaccgaccagacggcgtgtcacaccttcggctttctgtttctccagtgccgcacggttggtaaagttctttccgtcaacaaatttggtaatccatcccagaccagcctcaagcggtgaagtcgtatcgtcaatgtcattgccatagagacagaatcccatttccagccgaagtgtatcgcgtgcacccagtcctgccggtttaataccaaactccgcacctgcttcgaaaatagcattccagatacgatcggcatcctgaggataaaaataaagttcaaagccaccggcacccgtatatcccgtattcgagatgataacattcggtactccggcaaactccccaaccttgaatgtataataaggaatagacttcagatcaaccggcgtgagcttctgcaacgtatcgatcgctttcggtccctgaaccgccagctgtgcgatacggtcggatgagttttcgagttccgcacccaccgtattatgtgacacacaccagttccagtccttttcaatattggcagcattcaccaccagcatatacttttcgggttcataatagtaaaccagcaaatcgtcgacaatacctcctgtttcattcgggaaacacgtatactgcaccttacccggcgtaagcacggcagcattgttggaagtaacctgctggataaattcaagggcatgcggtccttttacccaaaattcccccatgtgggaaacatcgaaaacacctacagcctcacaaaccgtatgatgctcgtcgaggattcccgaatattcaataggcatgttataccctgcaaattcatgcattttggcaccgagagcaatatgcttctcggtaaaaggagttgttttcatcagatagaatgtttaaggttaatgtataatgatgaatcaccacagattatacatcgttctgtctgaagcgatataccagcccaaactggttataacctgtggtgaaaggagctattctccctgcattttagtaatcagttatcaatatctttttgcggtcagttcggcaatcttgacaaccacattcatagccttctcgatagactgaattggaacaaactcataacgtccgtggaaattcaacccaccggcaaagatattcggacaaggcaatcctttgaacgacagctgtgctccgtctgttcctccacggatggccttcaccttcggttccactccagcttcctgcatggcagcaaaagcaatgtcgatgatatgcatcaacggctctacctgctgacgcatgttataatactgatctttgatatcaatcttaaccgtaccttcgccgtactttttgtttatcttttcagcacacgactgcatgaaaatcttgcgtgcctcgaacttctgacggtcgtggtcacggatgatataagaaaccgtagcctgttctacttcaccagtcattccaatcagatgatagaaaccttcgtatccttcggtagtagcaggagtttcattttccggcaacatgcctacaaattcattggctacgagcaaagcattgatcatcttgcccttcgcatagcccggatgtacatttctaccctttacatgtaccttggcagaagccgcattgaagttttcgaactccagttctcctacttctcctccatccatcgtatacgcccacttgcatccgaacttttccacatcgaacttatgagctcccagaccgatttcctcgtccggattaaaaccgatacgaatttttccatgttctatctcaggatgttccttcaggtaagcgattgcagcaacaatttccgcgatgcctgccttgtcgtcggctcccagcagcgtatgaccgtcggttactatcaaatcctcgcctacatgatccagcaattcggggaactgtttcggcgaaaggatgatgccctcttccttacacaaaggaatatcctcgcctccgtagttacggataatgttcggattcacattctctcccgacatatcggggctggtatccatgtgagcaataaatccgatagtgggtatatctcgattcacattggcaggaagagtagcaaacaaatagccgttgtcatccaacgaaatatcttccagtcccagcgcttccagctcggttttcagatatttggcaaacaccatttgtttcggcgtactgggagtagcaccggttgactcgtcagactgcgtgtcgaaagttacatacttcaaaaaacgttcaattactgtcatatattctttcgttgttaatgattcttttgtgtaaaaataagaaatagcttccgaacagccaaacacattaccattttttaggcgttatttataatcggcgcatcccatttagtatatagccgttaaaaacacctagcataccacaaactcttacaaaaagacagggtagatactactttttttcatacttttgtagccgaaagtatataattatgaaaagaacaatcttagtatgtctaacatgcttgtttgcaattgcttgcttggctcaagaagcgaacagcataccaacgaacgataccctttccacacacacactgaataaaaaagaactgcatcagaagaaggttgcagagcgtaacttacactataatattctgggaggacctagtttcagccccgactttggtctgctggtaggaggaagtgccctcatgaccttccgcatggatccaaaggataccaccatgcgtcgttccgtattgcctgtggccatggcgtttatgtttaagggaggactgaacatcatggtgaagcctcaactgttcttcaagaacgacaggttccgtattttcggacagttcagctacaagaatacgtacgagaatttctacggaataggttacacaaccaacaaggattacgtgcgaagcgatacaaccagccagtaccggtacagcggcatccagattaatccgtggttcctgttccgattgggggaaagcaatttctttgccggaccgcaagtcgacctgaactacgacaagatcatgaatcctgccaaatacctggtagagcaggccgattacaaacgggcaggaggtgacgccagcggatacagcaatttcagttcgggactgggattcttgctgacctacgatacacgtgacgttcctgccaatccttacaaaggaatttatctcgacctcaggggcatcatgtaccagaaatggctgggaggagatgacaacttctaccgctttgagttcgactaccggcaatacaaatcggtgggacaacggaaagtgctggcgtggacggttcagaccaaaaatgtattcggaagcaatatcccgctgaacaaatatgtgctgagtggaacgcctttcgacttgcgtggttattacatggggcaatatcgcgacaagagtgctcatctggctctcgtggaataccggcagatgttcaataccgacaagagtaactggatcaaaaaaatcatccatcacctgggattcgttgcctggggaggagccggattcatgggacctacgccgggaaagatagaaggagtgctgcccaatgcaggactgggattgcgcattgaggttcagcctcgtatgaatgtgcgcctcgatttcggacgaaactttatcaaccgacagaatctgttctatttcaatatgacggaagcgttctgatacattaaaaaaatataaacggggaaagacgtatgccagaaatatcttcatactggcatacgtcttttttctttcctccaagactatttcttttcaggaaatcatcagaatggataattattcagaaaagatttcttattaccaccgttacagttttgtaacatacctatcatagctttgcagcgttttttttaaatcacaaaaagattgttgttaaatgaaaagaattagtttatcgtttttgcttatgctaatggtacacttatatgcattggcacaagtaaccacttcgggcatgaatggcttggtgaaaggcggtaatgaaccactgatcggagccacaatcgtagctgtacatgttccttccggaacaagttatggtacagtaaccaacatggacggacgttttatcctgcaaggtatgcgtaccggaggaccttaccagattaaggtatcctatatcggattcaaaacggctgtctacgaaaacatccacctttcattaggtgataatctcgtattgaatgtagacttgaaagaagaccttggagaacttgatgaagttgtggtagtcgctacccgctccaaactctccggaacgaagacgggtgcttctaccaatattaacaaccgcgaaatgaccgccctgccgtccatcagccgttcgctgtccgacatcacccggctctctccctatgccggaagcggaaactcttttggtggtagagatgcacgtatgaacaatattacgatcgatggtgccaacctgaataataacttcggactttcatcagctccgatgccgggtggatcgaatccgatatcgctggatgccatcgaagaacttcaggtaaacattgctccttacgatgtgcgtcaggctaatttcatcggtgccggaatcaatgccatcaccaagagtggtacgaatacgtttaaaggtactgcctatacgtatttcaaaaacgaaaacatgagaggaaacagaattgacggtgaagatctgggtgaacgccccgttgaagctcaccgtacatatggttttaccattggaggtcctctggtaaaaaacaagttattcttctttgtaaacggtgaacgtgaagaatcgcccagcccgatcttcaaatggcgtttgtctgaagacggtgtaggaaacgatgcggagatgatttcacgtgttaccgcagccgatatggaagaatttgccagcatcctgagaaaccagtacaactatgaaccgggatcgtataccgactacgatgctggtacgtttaccaataaaatactggcacgtttagactggaacatcaacatgaacaacaagttcaccatacgttacaattataccaaaaacaaatacaccaaccctaccagccagagtatgcctaacaaggatgtgtcacacggacactatggggttgcttctatgcctttccgcaacagctgctacgacatgaacaacttggttcactcgctcactgccgaattaaacagtaactttggcggaaagatgtctaaccagattctgggtacttataccaaaatagccgatgaacgtggctccgactcctccatcttcccgatggtggatatcctgaaagacggagatatgtttatgactgccggttatgaactgtatacgtacaacaatgccgtacacaacgacatctggacacttaccgataactttaccatgaacctcgataaacatgtcataacagctggtcttgcgtatgaacatcagtatgtaggcaactcatttatgtccagcggactgggatattatcgttataacagcctcgaggatttcaaaaacggagcagcccccatcctgtactcgcttacctacggctacggtggcgaagacaagcctgttgccgaactttctttcggacagttctctgcttacctgcaggatatgtggagcatcactccctatttaaaagtaaccggtggtattcgtattgatgcaccgtcttacctgaacgacctgcaggaaaacaaggttgtatcgggaatgacatttgcaggaagcgccaaaatcaataccagccagtggccgtcaaccaaaatcatggtttctcctcgtatcggattcaactgggatgtgttgaaagacaataccctgcgtctgcgtggtggtagcggacttttcaccggacgtattccgtttgtattccttaccaacatgcctaccaacagtggtatgattcagaacaccgtaaccatttccgatcctgctattttagccaaactggcgggcggagttatttccaagaacgacgtcattgcccgactgccggaacagttcccgcaaactccagtagaaaaggctccgggtacggtagcaggtatcgatcctgacttcaaactgccgcaggtttggaaaaacacattggcagccgatttcaagttgccgcttccgtttaataccgaaatgactctcgaaggaatctatgccaaaaacctgaatgcggtcatccagcagaatgtaaacgttattccgctcagcgatccgaagatgaaacgatttgccggtcccgataaccgttacctctatccgggagctaccgaaagccgcatatacaaagacatgtcgggagcctatatgctgaccaatacaacccgtggatatagctatagcctgaatgcttctctcagaatgaaccctgtagagaatctgaatgtcctgttatcgtatacttataccgattcaaaagaagtttcgggcaacccgggagcacagcccaacgagctttggcaaaacgtgccaaccgtaaacggaggcaactatatgcagctcaccaattcacagtaccttactccgcacaaggtgattgcttcgttgtcataccgcattccttatgccaagaacttcgcgacttcggtaagcctcttctactccggatataatgccggcaacttctcttacatgtacgatggtgacatgaatcaggatggtatcaacaacgacctgatttacattccgaagagcaaggatgagctgacatttatcgataagaacggatttacggcagcacagcaggcagaagctttctggaattacgtaaaccaagactcttacctgaaaaatcataaaggtgaatatgccaaggcatactctgcccgctatccgtgggtgaatcaggtagacctgaaagtggtacaagactttatcgtgaaagctggaaagacgaccaatactcttcaggtttcactcgatattttcaacataggcaacttgctgaaagatacatggggtatctctaaagttccggtaaacagcggacgtatcttgaaatacgaaggtgtaactgccgataatgttcctacttactcaatgtatcagtcggacggtaaacttcctaccgaaacattctcttacctgaaaaacagctcagactgctggcaaattcaggtgggtatacgatatatattcaactaatggttttatttttcatgggatattgccgcggagtacctgcaaaggtactttcggcaatattccttttttatttttcaagcatcatgaaaagacagattctatctattctgcttatcttagggctgatagctcccgtcatggggaaaagcagaaaagtagtcatcaagattatggaaaccaccgacatacacggcaatttcttcggatacgatttcaaggaaaatcacccgctggaaggaggcctgccacaagtagcttcttacgttcgttcgcaacgtgacagtctggggaaagaaaattgtattctggtggatgccggcgatgttctgcaaggacagccttgtgtttattacaccaacttcatcgatacgaaaagtccgcacctcgcaagcgaaatgatgaacttcatgggctacgatgccgctgccttcggcaatcacgacatagaagccggacaccccgtgttcaaccgttgggttgccgactgttcgtttcccgtactgggcgccaacattctatcgaaagcaaacggtaagccttatgccaaaccgtattgcattgtggaacgcgaaggtgtaaagatagccattctggggatgattacgcctgccataccgatgtggcttcccgaaaagctctggcagggactacaattcgaagatatggtagagagtgcaaagaaatgggtacctttcattctcgaaaaggaaaaaccggatgtcatggtaggactattccactgcggactgaagtcgcacggacaaaacggatacaatgaaaatcccgcggaggaaattgcacgcaacattcccggactggatattctattctacggacacgaccatcaggcgtattgccagcaggttaccaacaatgtttcgggcaacaacgtatggcttctcaatgcaggaggagaaacggtacacgtagccgaggctatcctgacctgctcggtagacgatggtaacgtaacggacaaaaaaatagctggaaagctggtatcggtgaaagggatgaaaccggatgaggcatttctggaacgcttcaaaaacaaacaagaggaagtacagaaattcgtgtccgaagaaataggtacgctggataaacccatttacggtgccgattatttcttcggcaactctacgataggcgatctcatgcatcatgttcagttccaacaaatgaaagccaacatttcgctggttactcctttggtatacgatgatgtggtgaaggccggcaaggtagctgtaagagatattttcacactctaccagttcgagaacatgataaacgtgttcgagctgaccggaaaagaggtacgcgatgcactggaatattcgtattcacgatgggtcaacacgatgaagtcgcccgacgaccatgcactgaatatccgtatgcaggaaggcaggaaagctcgtatcgcagcggcgaccttctgtctcatgtcggctgccggaatttcttatgaagtagacctgagccagcctgtaggaaaaagagtgcacatcttgaaaatgagggatggaagcccgttttcgctggacaagacttaccgtgtggcagtcaactcgtacgtaggtagtggaggatgcggactgttgaccgaaggaaccggattgtctatgtcggaactccgcagtcgcatgaaagagacttccgatcatgagttccgctattatatcatcgatttcttccgctcctcgaaaggacctctccagataactcccctgtccgactggaagtttgtgccagattctctggtaaaaaaggctttggaatccgaccgcaagctgctgtttggagaataaaatcggagcctgcctttagatattcctaaaaaatacccttcgttttgcgcttcacaaccggaaggcaaaacgaagggtattttcatgtataagaggatcgattgtatcagaaccggctggaaccgtcgaaacaatgtgtgcagaccttgcacttcggcagtccgatagcctcaatcaatgtttccagcgtattgaatcgcagggaagtcagtccgaagcgggcacggatacgctccaccagttccttgtattcgggagagtcggtggtagcatagcggtcgagcttagcattctcgtcgccctctatttccttgatgatacgacgggtaatcagttccatgtcgctcttggaagacgtgaatccgataaacggacagccgtaaatgagcggcggacaagcgatacgcatgtgcacctccttggctccgtaatcgtacaatatcttcacgttgtcgcgaagctgggtaccacgcacgatggagtcatcgcagaacagcagacgttttccctgcaacatggcgcggttcggtatcagtttcatctttgccaccagcgaacgcatctcctgattgctgggcgtaaagctgcgcggccaggtaggagtatattttgcaatggcacgatgatacggcacgccttttccttcagcatatccgagcgccatacccacacccgagtcgggaataccacaagcacaatcgacttctgattcatccgtcttacccatcttgtaaccgctcatgaaacgaacttcctctacgttacgaccttcgtagcaagacaccgggaaaccgtaatacacccacaggaacgaacaaacctgcatttcctcgttcggcttgcggagctgttccagtccgtcggcacgcatacgaagaatctcacccggtcctacatagcggtcgatttcataatcgaggttcggaaaactgctcgactcactggtagctgcatacgccccgttctttttaccaataacaataggcgtacgtccccatttgtcgcgggcaacaataatgccgtcttccgtcagaatcagcatcgagcaggaacctttgattttcttatacacattttctatgccatctacaaagtccttaccctgtacaatcagcaatgcgacaagctccgtctggttggttttacccagactcatctcactgaagtgcatgttggcatccagcaaatccttctccagttcggccatgttattgatttttgccactgtcacaattgcaaactttccgagatgagaattaatcatgattggctgcggatcggtatcgctgataacgcctatacccgacttacctctgaactttggaagttctgcttcaaatttcgtgcggaaataagaactttccagactatgaattgaacgtacaaaaccttctccttccgagaaagttgccataccggcgcgttttgttcctaaatgtgaattgtaatccgtaccgtaaaataaatcggtcacgcattcagccatcgagactgtaccgaaaaaaccacccattccttttttaattttataattaatagttcgattttcgagtgcaaaaatacgcaaaagacaagaagtacagaaaaaacagagcatagaaacttgattaaaatcaagaaatattcatcaaaaggagtgaatctttttctataacatcttttaacaaaagagaagtaggggaattatatagggcatgcgttaagataaaaaagatttccaagacactaataaaaaaaccatagccattatgacaaaaacgattttaccactggactttttcttattaggaggcgcatttatctctccatgcgaaaacgaagaactaaccgtagaatccggtatacccgcataccagcttgccaagccaaataatctggaatatccggaaaacaacagatcacaacctgtagaacaaccggaagaatatatcaaaatgtcacctcttccctcttgctgacattttgcatatctcgtcgattgagaatcatttatttccggagacttatacgaacagaagtttttaacgaaatcaaattcgaatgaatcaattatcaatcaaacagatagactgatttttaacatattattagagaggaaatagccatttttccttcattaaaataccgattttagagtttcaaagcactttatcgaaaagaaagaaccaacttgtcaggagattttttttatttctctcgacgtttttaaaatttctttcgccatatcctccaatacatgctcaggaattctgtataaaaagccagaatattgtatttccatgcaataatatggaataaaatttcagattaatcgccttgttctttgctaaaattgtcacactacagaaagtgtaaatttatgtttggccgcgttatccgacaaatgaatactatcaaaccacattttgattgcattttgataacgctccgatttcatcccgacgggacagcaatatccggttaacatcatttacacggcgtcattccagcccgaatgccggcaagaaagaatgactataaaagttctccggaaaaattttcataaaaaaagacagaaagattaaacaaaagcgctacaggattgttttattatacgacagaagaattaaagaggaaaacaattggactaactaaacttttatgtacaagtaaaatgctgccgctacaacaccggcggcattttttatgcgcctaactaagtcttcagggggataaaaacaaaaaagttggaaaccatgttccaacttcttcgagcctcttgtcggattcgaaccaacgaccccgagattacaaatcacgtgctctggccaactgagctaaagaggcaataactatgttttattttcgagcctcttgtcggattcgaaccaacgaccccgagattacaaatcacgtgctctggccaactgagctaaagaggcaggtgggtaagcttaccatatcgcgccgctacaaccaactacctttgctgcgatcaagccctggaggattcgaagggagctggccgtatgggacttacccatgttaggtctgcatcagagattcatcgtgtgatgtttctcatttgcgggtgcaaaggtagatatattttttgaacctgcaatactttgtctcaaaaaaatgcacaaaaattgaagaaaacgctatttttatcggttttatagcccggaatatctccaaaaaacgtacttttgtagtcttaataatataaataataaaggaaaaacagaaatgccaacagacaaaccgattacacttcaagaacatgccatgcgatttggtactttcatgggaatatactggataattaaattcattttcctacccttaggattcagtattcccttccttcagctcttgtttgtgctgcttacgcttttcgttccgatactgggctacatctatgtacgcaagttcagaaatacgtactgcaacggtgagctatcgttcttccgtgcgttcgtattcacgctatacatgtatttatttgctacgcttctggtagccgtggcacactacatttatttccgttttctggatcatggctttctggccaatgcctacttgcagcagttggaaaacgtcaaatcggctgcacagggtgaaatggcaacttccatcgaccagttgattcaggcgttcgatgccatttcatcgctcacccctctgcaactcacttttcaattgatttttcaaaacatattttacggtatcctgcttgccatacctactggtctggtagcaatgaaacataaaaaacagttctgacctatggatatatcagtaatcgtacctttatataatgaggaagagtctttacccgaactgcatgcttggataaagagagtaatggatgcaaatcacttcagttacgaaatcattttcgtaaacgacggcagtaccgacggttcgtggaaggtgatcgaggcactgagccagaagaacaaggaagtgaaagggataaagttccgtcgtaactacggcaagtcgcctgccctgttctgtggcttcgaacgtgccgaaggcgatgtagtcatcaccatggatgccgatttgcaggacagccccgatgaaattccagagctttaccgcatgattaccgtcgacggttacgatctggtttccggatggaagcagaaacgctacgatccgctgtcgaaaaccattccgaccaagctgttcaatgctacggcccgtgccgtttcgggtattcacaacctgcacgactttaactgcggattgaaggcgtatcgcaaggatgtggtgaagaacatcgaagtgtatggcgaaatgcaccgctacattccttatctggccaaaaacgccggcttcaacaaaatcggtgaaaagatcgttcatcatcaggcacgtaaatatggaaagaccaaattcgggctgaaccgcttcgtcaacggatatctggatttgctcaccttgtggttcctgtctaccttcggtatcaagccgatgcacatcttcggttttctgggttccatcatgtttatcctaggttttatcgcagtagctattatcggtgtcaacaagttgtacgacttgtattcgggtaatccctaccggctcattacagacagcccgtatttctatctggcactgacgacgatgattatcggtacgcagctgttccttgccggatttatcggagaactgatagcccgcaatgctcctgaacgcaacaaatatcaaatagaaaaagaactgtaaccatgagaaaactaccggttatattaggcttgcttttattgttatgcgtgttcttccccgcctgtgaggtggaaaactgtccgcctaactccatgtcgtatgcgtacttttcactggtcgaccaaaacggaagatcgttcagtacgtcggatactataaccattgtaggacaaacgcatgccaatatcgtggtatacgatacacttaccgacggaagcctgcgaccgcgtaccgtcgattctctgatctcggatacgctggtcaaccgtgaagcgggtgccaagagctttgaacttccgctgagctataacaccagtacccagttcgtattcagttaccacagtctggaaaggatgtttgccggaagagataccatcagtatcacgcaccggaacattccgtatttcttcaatctggactgcagctcgatgatgttttacgaagtgaccggagtaacaagtacccaccaccgccttgactcactgactataaccaacccgaatatagataataatgaaaaagagaacttcaaaatatatttcactgttattgcttctgacgagtagcctgctgcttccgctgccggctcatgcgcagaaaaaggacaaggaaactctgaaaaaggaatacgaagcatctccgctctatcagggaacttccatcggagttgaagttgccggcgcagcaggatacctgctgggaggggatgcgctgagcagcgaaatcatcttgcagacgaacctcaagaaccgcttcctgcccgtcatcgaagtaggttacggaaaaacggatgccaccaacgatgctaacgacatgcactttaagacatcggcgccttacttccgcgtaggtatggactacaacgtattttatcagaagccttacctgccgggatatctgtatgtgggcctgcgatacggcatgagcagttttacctacgatgccagcggtcccgacatgaccgacccgaactacgggggacacatcaccgtaccttatgccgacttgggcgaaaagagcagtgcacactgggtagaaggtgtggtaggcatcaaggtaagaatatacaagcgcttccacatgggatgggccgtacgctacaaaaagcgtttgagcgtcaccgaacacgagaactctacgccgtggtatgtacccggattcgggaaaaatgcaggaagcagcttcaacctgacgtataatttaatttataacctacctttttaagcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgtttaagtatacatgactactctggaaatatggctgctcgccgtcagcctggcgatagattgttttacggtctcggttacaagcggtatcatcttacgtcgcatccaatggcggacattcctgaaaatggcttttttcttcggcttcttccaagcactgatgccgctcatcggctggttcggggcaagtcgtttcagacatctcatcgaagcatacgaccactggatcgcctttgcactgctggctttcttaggtatccgcatgatacgcgaacatttcaaggacagtgaagagtgcagcttcgaccctacccaactgaaggtgatcctcactatggcggtggcaaccagcattgatgcgctggccgtaggcatctctttcgcttttacgggattcaacgacgtagaacaattgtttagcccgctgctcatcatcggtttcgcctcgtttgtcctctcgcttgccggcagcctgatcggtatcttcttcgggaaacgttttaacctgcgcgtggaacttttcggcggtctggtgctgattggcatcggcgtgaaaatccttatcgaacatctttttctaaatcaataaatcataaagaattgcatctatgacaaataaaaacgcaaaatggcaacttccgttcttggcttttctgattatcggaacggtactgattcttcggaaacaagctccttaccagacggatgaagggctggtattcggtacgatgtacaaaatcacttaccagtcgaaggaaaacttgaaaaaagacatcgaagctgaattacagaaagtggataactcgctctctccgttcaacaagcagtcggtcattacgcatatcaacaacaacgaaaacatgcagacagacagtatgtttgcgtatgtgttccgtctggctaaggccgtatcgaccgacacgcacggtgcctttgatatcactgtggctccgctggtaaacgcatgggggttcggtttcaagaatgctacgggcatacagccgaataccatagacagcatccgccagtttgtaggctttcataaggtagacttgatagacggtaaaatcgtaaagaaggatccgcgcgtaatgctggattgcagcgctatcgccaaagggttcggagtggactgcgtggcacgcctgctcgacagcaagggggtcaagaactatatgatcaacatcgggggcgaactggtcatgaaaggtgagaaccagaacatggaaagctggcgcatcggcatcaacaagccgatagatgactcactttccgtaaatcaggaattgcagacggttctcgaaattacgaacgtaggacttgccacttcgggcaattaccgtaatttctactacaaggacggcaagaaatatgcgcataccatcgacccgcgtacaggctatccggtgcagcacaacattctttcgtctaccgtcgtagccaaggactgcgctaccgccgatgcctatgccacttcgtttatggtgctgggacttgattcagccaaggctatctgcaacgcgcatccggaactcgatgcttacttcatctacgaacgtccggacggtaagatggatatttactttaccgatggcatgaagaaatatttaagaaactaaatacttgaaaaaccatgaaagagacaaacgaaaaaccgacgggattgcccgaaaatgcattccgtccactcaagccgggagagcagtatcagccgctgatgtcgcccgacaaaaactatccggaggtgaacctctggtcggtgttatggggtattgccatggcgatactcttttctgccgcctcagcctatttaggactgaaagtcggtcaggtgtttgaagctgctattcctatcgccatcatagccgtaggtgtttcgagtgccgccaagcgtaaaagtgccttgggcgagaacgtcatcatacagtctatcggagcctgctcgggtgtaatcgtagccggagccatctttaccttgcctgctttgtatatcctgcaggacaaatatcccgaaatgacggtcgactttttccagatgttcgtcagctcattgttaggaggtatcttgggtatcttgttccttatcccgttccgcaaatactttgtcagcgagaagcacggagaatatccgttccctgaagctaccgccagcacgcaggtacttgtttcgggcgaaaaaggaggcagtcaggcgaaaccgttgctttttgccggactgataggaggtctgtacgactttatcgtggctaccttcggatggtggaacgaaaacttcaccacccgcgtctgcggctggggtgaaatgattgccgaaaaagccaagctcgtcgttaaaatcaataccggagctgccgtgttaggactgggttacatcgtaggtctgaaatatgctgccattatctgcgccggctcacttgccgtatggctgattatcgtgccgggcatctcactcatttggggagatcaggtactgaatgcatggaatcctgccatcaccgaaaccgtgagcagcatgtcgcccgaagcaatcttctctcagtacgccaaaagtatcggtatcggcggtattgccatggcaggtatcatcggtatcgtacgttcctggagcatcatcaagagtgccgtaagtctggctgccaaggaaatgggtggcaagaaagcggaagccaatgtagtgcgtacgcagaaagacttgtccatgaagattattgcaatcggttccatcatcaccattatactggtagccttgttcttctatttcgatgtgatgcagggtaatctgctgcacaccatcgtagccatcgtgctggtagcaggtatctctttcctgtttaccaccgtagctgccaacgccatcgccatcgtaggaaccaatccggtatcgggcatgacgttgatgacactgatcttagcctctgtcgtgatggttgccgtaggcttgaaaggagctaccggtatggttgcttccctcgtcatgggaggtgtggtttgtaccgcgctgtctatggcaggaggtttcatcaccgacttgaaaatcggttactggctgggtagcacgcctgccaagcagcagacttggaaattcttgggaacactggtttctgccgctaccgtaggaggtgtcatcatgattctgaacaagacttacggattctcatcgggcgctctggctgctcctcaggcaaacgccatggctgccgttatcgacccgctgatgaacggtgtggctgctccgtggctgctgtatggcataggagctgcactggcactgatactgacatatttcaaggttccggcactggccttcgcattgggtatgtttattccgctggaactgaacctgccgctcatcgtaggtggagccatcaactggtatgtcactacccgcagcaaagacgaagcggtcaatacggcacgcggagaaaagggtaccctgcttgcttccggtttcatcgccggtggtgccctgatgggagtggtcagcgcagccatgcgtttcggcggtatcaatctcgtaaacgaagcatggctcgaaaatccgctgagtcaggttgtttcgctggtagcatatatcttgctgatcgtatatctggtcaaagccagcatgcatatcaagaaagcttaaagcagaaaatactgaatctaaactgacagattccattcacccacagacctcctgcacccgcggaagtctgtgggtattttgttatcttaaaagaattatgttatctttgaacccgtcaatcgaaaaacatttcatactgaacaaccgactttcatcaaacattccaaaacctaacgaaacacaccagcttcatcgtacgatacagtatgaataaacagccccaaagatatgagctaccaaacgctacatgtccttcatcgtacgatatagtatgaatacaaacggatgacaaagaaaaaataaaacagaacaacaaaatcaatacacgtatgaaaaaactatttctcatgagtctggtctttctttcgaccatgctctccgctcagaatccagtagaaatcaaattatggcctaacggagctcccaacagcaaccacatgacccagcaggtggaaaacggtccgctctatgtagcagaacctacgctgacggtctatctggcgaaagaaggcaacggaatggctatcgtagcttgcccgggaggaggatatacacaccttgccatgcagcacgaaggacacgatatggccaactggttcaacagtcagggtatcacgtatgccgtgctgacgtaccgcatgcccaatggaaacaatgaagtgcctctgagcgatgcccaacaggccctgcgtatcatgcgtcagcatgccgatgaatggaatatccgacaattaggcatcatgggagcttcggcaggaggacatcttgccagcacggtggccactcattttaccgatgcagctacgcgtcccgacttccagatactgttctaccctgtcgttaccatggacccgacgtatacccacatgggctctcacgataacttattgggaaaaaatccttcgaaggcactcgaacagaaatattccaacgaactgcaggtcactccgcaaacccctcctgcctttatcatgcacagcagcgacgacggtgccgtacccgtagccaacagcgtgaactactatctggcactggtcaagaacaaagttcccgcctgcctacacacctatcctatcggcggccacggatggggattccgcgactcgtttacctacaaacgccagtggaccggcgaactggaaaaatggcttcgtgaaataaataacaaataataacgacttaaccttttgtaatacaaataaaaatcgtacctttgcacccgctaatacgggatattagcataattcaaatcattaacattaaaaaattaacgtttaagaaatggcaactaaaatcagattgcagagaaacggacgcaagagctatgcgttctattcaattgttattgcagatgcaagagcaccacgtgatggtagatttactgaaaaaattggtacttacaatccgaataccaatcctgccacagtagatttgaattttgaacgtgcattacactgggtaatggtaggtgcacagcctacagacacagttcgcaacatcttgtctagcgaaggtgtttacatgaagaaacacttgctgggtggcgttgcaaaaggtgcattcgatgaagctactgctgaagctcgcttcaacgcttggaaagaaaacaagcagaacggtctggctgctttgaagactaaagaagaagaagctaagaaggctgcagcaaaagcacgtctggaagcagaaaagaaagtaaacgaagaaatcgctaagaaagtagctgaaaagaaagctgctgaagctgctgctaaggctgaagctgaagctgctgcaaaagcagaagctgaagaagctgcaccggctgctgaagaagctccggctgaagcataattcgttacttcacaaaagacattgcagaagaggatatatcacccgatatatcctcttttatttttataaccggcgataggcttcttccagctgtttcaatgcttgttccagcacagcacgtgtacaacctacattcatgcgcatgaagccgattccttctttgccgaacgtttcgccgttgttcagggcaagatgagctcccgacacgaagaaatcttccagtgcctgctgcgacattcccagctcacggcagtccagccataccagataggaagccatcggacggatagccttgatcttcggcatctttttcttcaggtattcatccagatagtcgatatttccctgtatataagccagacactgttccagccattccgtcccgttggaataagccgcctctacagctggaaaggcaaacacatgtcccccgccaaattcacagctctccatataggtagtaaaccgcttgcggagcccctcattataaataatagcatgcgaagctgccactcccggcatattgaaagccttgctgggtgccataaacgtaacggaattgttctttgcccgttcagaaatcatggcaaacggtacatgatggtgagaaggtaaggtcaggtcggcatgaatctcatccgaaaagacaatgacattatcctctgcacagatattggcaatggcttccagttcctcgtgcgtccagaccactccacccggattgtgagggttgcacaagataaacacacgtatgcccttaatctccctgcggaacaaatccagatccatccggtacttgccgttctccagaatcatcggacactctaccagccggcggtcgttgcgggttactagccacgagaaaggcggatacaccggaggcataatcatgatcttgtcgcccggatgagtgaaggcattgatcgccatccccagtcccggcacaatgcccggcacatacgtaatctgttccttttccaccttcatgccgtaacgcgcatccacccagttgatgattgcctgataataactgtccggcttgcaggtataccccaacaccggatgttcacaacgtctcttcaccgcatcgagaacaaacggaggagtggcaaaatccatgtcggccacccacatgggaataaggtcggttcgtccccagatatccttcattccttctattttttccgcattcgtacctctccggtctatcggttcgtcaaaattataattcatggtaatagtattttaaatatatattgatctaacacaaatgtaatcgaatatgtcgtggaaagaaaatatttaaagaaaaagttcatagaatgtttgttttttcaagaaaagtattacatttgcaaccgtaataataacaaaataacagaacaacgaatgaaaacatttgcgacatacttcttcttttactttttttacttttactttagcaatgaagtgaagcgggagttcgcatgtgtaacaaaccaatgaatcaataaaaacgatataacgaaatcccgctttttacagagcgggattttttattttaaaacaagagcaaatgaaaagaatagcgatacaaggtgttccgggttcataccatgacattgcagcccacaagtacttcaagaatgaagaaatagaactgatctgttgcaacacattcgaagaagtattcgaaaacatgcgtaaggacagcaacgtcatcggagtcgttgccatagaaaatacgatagccggaagcttgcttcacaactacgaactgctgcgcgaaagcggggcaactatcatcggagaacataaactccgcatcagccacagcatcatgtgcttgcccgacgaggactggaaggatctgaaagaagtcaactcgcatccggtagcactggctcagtgccgcgagtttctccagcatcatccggagctgaaggtggtagaaacggatgatacggccggcagtgccaaggatatccacgaaaagcaactgaagggacatgcagccatctgttccaaatatgcggcaggcatgtacgacatgaagattcttcaggaaggcatcgaaaccaacaagcacaactttacccgcttcctggtgatatgcgacccgtggatcgccgacgacctgaaagaccgctccaaggtgaacaaggcaaacattgttttctcccttccgcacagtgaaggaagtctgtcgaaagttctttccatcttttcattttacaacatcaacctgacaaaaatccagtcattgcccatcatcggacgcgaatgggaatacatgttctacgtggatgtgatgttcaatgattacctgagatataaacaatccatcgatgcggtaaccccgctcaccaaagcacttaaaatattaggagaatatgcagaaggagaatcaacattataacatacagcctgccgaccgactggcaagcgtaagcgaatattatttcagccgtaagctgaaggaagtggctaagatgaacgccgaaggaaaagatgtcatcagcttaggtatcggaagccccgatatgccgccttcggaagaaaccatcaaggtgttgtgcgaaaatgccaaaaagccggatgcacacggttaccagcctacggtaggtattccggaactgcgcaaggctatggccgactggtacaagcgctggtacaacgtcgatctcgatccggctacggaaatacagccgctcatcggttcgaaggaaggtatcctgcacgtcacactggcactggtcaatccgggcgatcaggtactagtaccgaatccgggctaccctacgtatacttccctgaacaagattttaggaagcgagattgtcaactacaacctgcgtgaggacaatcactggcaacccgatttcgatgaactggaaaagatggatctgagccgtgtaaaaatcatgtggaccaattatcccaacatgccgacaggtgccaacgctaccatggaactgtacgaaaagctggtcgactttgcacgccgccataacattgtcatcgtaaacgataacccgtacagcttcattctgaaccgcaagcccatcagcatcctcaacgtgccgggagccaaagaatgctgcatcgagttcaattccatgagcaagagccacaacatgccgggctggcgtgtaggtatgcttgccaccaatgctacgttcgtacagtggatcctgaagataaagagcaacatcgactcaggaacgttccgccccatgcagttggctgccgctcaggcttatcgtaacagtgcggagtggcacgaagaagcaaacttcaatgtatatagccgccgccgtaaactggctgaagaaatcatgacgaccttgggatgtacattcgatcccgatcaggtgggtatgttcttgtggggaaaaatccccgactcgtatgccgatgtggaagacctcaccgaaaaggtgctgcacgaagcacgagtattcatcacgccgggattcatcttcggcagcaacggaaagcggtacatccgcatctcgctctgcgccaaggaagagaagctggcagaagccctgaaacgtatcaaagcaatattctaaagaataataaactaaaataaagatattatatggaactgaatttacaacctatcgaactggaaggtgtttcaaaggaacgccctcttatcatagcaggtccctgtagtgctgaaacagaggaacaggtaatgacaactgctacccaacttgctaacaagggtatcaagattttccgtgccggaatatggaaaccacgtaccaaaccgggaggtttcgaaggtatcggcgtagacggactggcatggctgaaacgcgtgaaacaggaaacgggtatgtatgtcgctaccgaagtggctacagccaagcatgtatacgaatgtctgaaagcgggtatcgatattctgtggataggtgcccgtaccactgccaacccgtttgccgttcaggaaatcgccgacgcgctgaaaggtgtagatgttccggtatacgtaaagaacccggtcaaccccgacctggaattgtggatcggtgcgctggaacgtatcaacaatgcgggactgaaacgtctgggagccatccaccgcgggttctcttcgtacgacaaaaaaatctaccgtaacctgccgcagtggcatattcctatcgaactgcgccgtcgtattccgaacctgcctatcttgtgcgacccgagccatatcggcggtaagcgtgaactgattgcaccgctttgccagcaggcgatggacttgggcatggacggactgattgtggaatctcactgcaatccggactgtgcatggagtgatgcagcacagcaggttactcccgatgtactcgattacatcctcaacctgctggtcatccgtaaggaacaccagtcgactgaaagcctgcacgagcttcgtcaacagatcgatacatgcgacaacgagctgatggaaattcttgccaaacgtatgcgtatctgccgcgagatcggtacgttcaagaaagaacataacatgacggttcttcagaccggacgttacaacgagattctcgacaagcgcggtgcacagggttctctctgcggcatggatgccgacttcatcaaacaagtgttcgaagctatccacgaagagagcgtacgccagcaactggaaattatcaacaaataattaagaactaacagagaagaatcagaaacccaacactttctccaacgacagtaatgagtttctgattcttctttatacactatctttcattctacaaactatgagaatattaattatgggagccggaaaaatgggctcgttctttaccgacgtattgagcttcgagcacgaagttgcggtatacgatgtcgatcccaaacgtctgcgctttatgtacaactgcctccggttcaccgaactcaacgaaatagaagccttcaagcccgaactggttatcaatgcagcaactgtaaaatataccctcgaagccttcaatcaggtacttcctctcatcccaaaagactgtatcatcagcgatattgcttctgtcaagaccggactgaaggagttttacgagcaaagtggtttccgctatgtatctactcaccccatgtttggtcctacctttgccaacctcgaccagttgagtacggaaaatgccatcatcatcaaggaaggcgaccatctgggcaagattttcttcaaggatctgtatcagcgactgggactgaacatttttgaatatacattcgaggagcacgatgaaaccatggcttactccctgtctatcccgtttgtttccacctttgcctttgctgcggtgatgaagcatcaggatgcgccgggtaccaccttcaagcgtcacatggctatcgccaagggagtgatgagcgaagacgacttcctgttgcaggaaatcctgttcaacccgcgtactccggcacacgtagaaggtatccgtaccgagctgaacgagctgctggatatcatcaacaagaaagatgctaccagaatgcgcgcttacttggcaaagattcgcgaacatcttaaataaccaacctctttcctatatcccttatctctctatggttaccttcattcaatccgtaaccaatagagagatttttttgtccgttcctccgcacccgccagagtaataagggataacttttttttatgacaatatctcggacagaagtcgtacctttgctgtacgaaaactaatttaatttttcacgactatgtataaatcaatcattcgtccctggttattccgcatcgacgcagaaaagattcacaacgaaattatcaccctgttgcatgtctatcgtcaccttcctccggtaaagagcttcatccggtcggtttaccgtccgaaggcaacgcctttccagtggcagaacctgacgttcggcaaccgtgtgggactctctgcgggtttcgacaaggaagcaagctgtttcgacgaactgagtgatttgggcttcggcttcctcgaagtgggaacggttactcccgagaaggtcgccggaaacccctcccccgcatcttccgtctgcctcaggatcatgccttggtttcacgtaccggattcaacaatcccggaaaggcagtcgtcttgcagaacctgaaacggaaacggaatgggaaatacatcttaggagtgaacatcaataccaaccatccttcggacgaagcactggctgtggcagagctgtgcgacctgtatgatacgttcagcgcgtatgccgattactataccctcaactggggaagcatagctcccgagatactgggtgcagcgctcaccgccctgacagacgacaagcagcatgtacgcaagcccatactgctgaaacttccggcagatgtacccctcgaaaagctggacgacatcatcggctttgcccgtcagcaccacgtcggtggcttcattgctacaggtcccacacaagaccgttcgctgttcatccattccagccagtcggaaatcaccgaggtaggtgccggaggtatcagcggactgccggtcatccacaagtcgattgaggtagtgaaacaccttgccgcccatgctcccaaggagatgctcatcgtcggagccggaggtgtcatgaccccgctggaagcccacagcatgctcaatgccggtgctcatctggtgcaggtgtattcagctttcatctacgaagggccgggcatcgtaaagcgcatagcagaagcgtgcaagtaaagatttaaacgtgcaaaaatagaaagagtcgtatcattcctcacgaaactgagtttgatacgactctcttttattttgcagttactatattccgtaacttttcggagtaactatagggaatacactccttaattattaaattcacttccttttaaatatccttatccggttatttaaaagtttgaattttaaaaatctacatcgcttcccttattaaccaaaagctgatacttgatataccctcccgacttagaagaatacttagtatagatagcggtaatagaacccttgtcgccattttccggcaatggattcaaagcaaaattagcataaccgctcacacggagaatcagattacctatcttatctttctcatccgaagcattatacgtaaagagtgaagaaccataataacgctgattattatagttgtaggcaaaagtaggagtcaatccctctttatcataatatttattcgtataagtagcttctgtagaattgttcaggtatacagtttccagatattgtggataggtatcgccatcaaacgttccagccttgtaagtcaagccctcaaaacgaatcaggcgtccaagatgagcatcactcagcacagtcttgtaattctgcggggtaaccaccagcgtatccgatgcttccagtttacccagctcaccggcaaagatatgtgcattgcgctccatctgagtatcaaggttacggttggcatagtttttggaaatatcttctgcagtaggaataccgcctacacttaacatatagcgatagttaccaatggcaagccctttcagcttcacatacaatgtctgtcctacctgatagtacacatagttgctcaccatcagtttcaattcgataccagccgtaccatcataaatataaacagacttatacacgttgcccgcctgatcactcgaaatcacctttcctttaatcacatagtcttcggttatttccttgtaaccagccaaaggcacattggcacacatgtctttcaattctttgatagaaataagctgacagccttccgactcaaaatcggcagccgtccaaaccttagcaggagccggttcgtcaaaatcactgtagcaactagtaacacccatggaaagtgccaccatcaaactacctattatcaatttatttatcataacaatagttctttttcagggttagaaacggaaatataaattcaagtaataattggtaccaaacatatagaagtatttagaatcgaaaggctggtaagtaagcgtacttgcctccttgttcttcaacagacgaatctgttcataaccgccagtcttaatattctgattgttcagcaaattatctacactcagactgaatcccaacgtataagaacggttgatgtaccagttcttgccaatacttgcattcagtacataagccgcatcaaatttctcctgaccacgaatatcttccagcattgcaggattttcaagcatcggcttagtcagtacagcatcggtacgatacagcgggctcatcgacagatacatgttgttataataattcaggtcgagtgacgcaaatatattattgcgactacgataagacaaaccgatattggcagctgtctgcggagtactttctactcgcttgtttttccagtaaacctttccctggttgatgattgccgcactattatcctgaatctgtacataattcggattattcgaataaatatactgtccccagctcaaagctcctttcagtgacaaaccttcatacaatggtatagaagcagccacttccagtccgaaatgctgtttgttgatgccgctcatagcaaaattggaataagtagcttccacgtcatcatagtaagaaatcaccttcgtctggtctgtaaaagttgtatagtaaccagaaacacgtgccttgaaatctcccatgcggaaattataagaagcatccactccaaagattttctctgcttttactccgggggtaacatcattacgtgtacgaggagaaacaaaagccgactggaacgaaggtgcgtcttgcatgtacacaatgttagcttcaaaattatgagcagaagaaagtacataacggaaattagccttaaccttgtaagtcaggtaatccagcaaatcagaatctcccttggaattctcatagaacaatcccttacgccagataccgtgacgccatagagcagcatatcccagttcggcaccaagtcctatctgcaggttattcagagagaaatcatattgcagccatccacgaccattgaacacatttgcataataatcgtagctatatttatcgcccacacgtgcgataggagctcttccgtactgctcataataatccatgttgttctggtatgaaatgatatcgatacccagatcgcgttcagcaaacttgtcgatatcaacccagtaatcaccacccagcaagtctttaacctcgctgtaatattctgtacggttacggcgtacattgatacctccattcagtttcgaactgttcttgaaaagatgagagaactgagtatagaagttccagtcgagctggtctgtatgacgctcctctatcatgttgatagaacgatgaccgtctccgtatgcttcattgaccggctggttacggtttatcatgtacaagttgtcccagttaatgtaacggatattgtctgtatttgccatccatgcttcctgcaaccaagctccagtagaagtgttaggatagtagcttggcaaatagcggtaatagtcaggacgaggatccggtccaccataccatgtcaatgcagaataaccattctgaccaaagcgaagtgatgttgccacgttcagctgagtacggtctgtaatgtcgaatgtatagttaagcatagccagaggttcgtggtaatcacgcacacgtgcattacggcgtttgccgttctgccagccccagtttggattatagtaattgtttcccaccaaatcgtatgcctcctgtgtagaagcctgctgtgcaccacgttctgtaggagcacccaagactgtcagagacaagcgatgctgcggattaaactgcttttctacggcagcaaaataaccataagcattgtaatatacaccatttacatatgcattgtttccctgacgggtagatacagaaaatgcatacgaccatccattatcctgcacaccagaagaataagtaagcataccacggaagcggtacattgagtttgtgctaaccaagctggctctcaaccccttacgcatttgtgaaggacgagtgttgatattagttactccaccaataccaccaattcccatctctcccatttccagtccggtagttacttcctgattgcgtgttgcatcattcaatccactccagagcgaccatggtgtataaccggtcattgcatcgttcaactgaatgccgttcatgtatacatccgagaactgagagtcatatccacgtacgttgaaacgcatttcactgaattgataagaagcgatattattgaaaacatcctttgatgccgacaacgaagtaggcaacgactgtgcatcttccatagtttccgtatcaaactctgcaaatatcgcatcatccagtacaggctgacgattggcaggaaccatgataacacgcatttcacgcatgttctttccgacacgtaccggtaaagttaaatcttcaaactctgcagtttcaaaacgcagttcatactcaccgggagccacattctcgaagaagaattcacctttgtcatcagtcgacgcagtacggtcgcctggaacgagtgtaatcttcacgttatcaatttttgcacgtgtagtacgcgatatgaccgtacccttaatgcctcctcccgtctgggcaaatcccgtaacggcaagcagcgacatcagtaaaaacaataatgtcttgaatttcataaaattgtaattatttgattacttacctatataaatatacaccggaaaatggtcactgaaacctccctgaaagttattacctacaaaagtacgcaacggatatcccttatattgtccttccttctgtaccatgtagtgacgtctgaagatgttaccgtaaaatttcgatttttccgatttctgaatctgcaactttcctttctcgttatccagcaagtttccacttactacgatattgtcgaaaatattccacgcatcgccatatgccagtgttccatatccagccttcagcaaggcagcatacggtgcataatagtcggcaggctgaacctcctttacctttatcttagctcccataccttcggctccggaaacgctttcgtctattgggtcatcattaaagtcacccatcatcaccactttcgtagctggacgcaaggcacggacagaatctgcaatttggcgcatctgccgtcccactgccacacgcttgaattcggaagcctcttttcctcccagtcgtgaaggccagtgtgccaccataaacaggaaatcttctccttctatctttccccacatcgttacaatgtcacgtgtcttgaagtcgggcaatgaaggaattaccgtacgaatagccttcgaaccttccagcttcaacacatccggacgatagatgaaggcagcatctacaccacgtgcttcgggagaatcataatgcacaatccgataattggctggtgccaacttttgagtagcaacaatatcctccagtacattacggttttctacctcacatacacctataactgccggataatccttgttgatagctgctatgtcaaaaaagactttttctatattatgcaactttttatcatacttatcctgagtccacttcttaggtccgtcaggagtaaactcatcatcgagaacatccggatcattttgtgtatcgaaaaagttctcaagattgtaaaacactactttgtagggctttttctgtgcgtatcccgacacagacaatgcaacgagcaataccccaagcattaatattcgtttcatacttatagaaattagttaagattccattcaatggcattgaaatcgtttttcacttcctgcggtatacccgggaagaaagtaaatccggtaagttgttctatttcggaaacttttttacatatagctttcgatggctgtgattctgaataagctttattctccagccaaaagccgatagtctgcaactgagaagcatcacactgattcacccatttgccagaaactcccgatttggttcgtaaaagaaccttgaaataatgagtcggcacatctacctttactccattattatcggtagcctgtttggaagcattcccataataagctccagtcaccacgtaaagtgtatcagagcacatatagcttttacgtaatttatcctccagattcatccagatagactgatttaacccctttcctgtctgaggagtctgatttgaaaaatagaaggtctgcgcattcatctcacgagtcattgtccggtcggccgacggaatctgatgtccgcgatcgtaagcaggatattccttatatgccctagctacaaatatctgatattcttctgcaatatccggatcgtatatccactcatcggttctatctaagccaccaatatagcagctatgaagcggataggcaacccaaagtgcacctttgtgtgatttatcatagcacatagaataattacgaacttcttttccgttcaaattaacataatgggttacatactggaaattagtaccttctttatatgcgggaatctctgcccacgatgtagaaaattcaggactatttacctgtcctttttgtgaaagcgtaagaactgtctgctttcctccagcaaaactgactgtgacagtagcctgacgctgtgcatcattgatattgtccgaataatagacatataatacattcataccctccaccaatgtaccttccttggtagcaatctttgatgaaagagaaaaagaacaccattctgatccttccgtaatttcagcctgccactgagttcctgctgtaccttccatccggatagcagcattacctttctgagcagctacagatgaagaattgttccaataagccgttccggaaggagcaatctctgcaccctcatcacttccgcacgcccacaatgtaagcgagagaaatgctattaaaaaataacggaacatagttgtttgtttatttctatccactattatcatatgtattgtagaggacacagagggacacagagtttttctccgtgtccctacgtatgctcaaaagttatatcgttcaactacaaggatttcaattaatataattgaataccacacataaatgcacgattacctgtgcttgaaccactacctgtaaaatctgcacttgtagagattgtaatcgtagaggttgctgtcaagcctgtaagttggagtgtataataatccgaatcctcaaaatttacagtaaaaggaggattcccagtgataccagtctttgcaggaacagctacactgctcgcaccgtttacagctccgccaccatttactttaatatataaagtagctccaccgctatacgctccggcatagaatgagaactttttgtcacctgaaactccaatagctccagaagtaaatacaccagcttttgaactggttccaaattttatacctgaaatttcatcagaagatccgttgataaatgctcctccctcatacatattaactttatcagtaccattttcaaacaaaaatgcatccattgaagtaaatgtaccctttgtatcactacctgttccctgagcagccactgttaccggtacttctacagaagaagaagttccatccaatgtaatcttcaaagtctgagatacagattcagccgatgcattagcctgtgctttcactgttacgacatttccgcttacggtagccgacaagataccagacaaaccagaagtgctcaaagtcttaccttcgccattggctacggttacagtaatatctttagtaccgccttctgcagcaaaactaactttttcaggattaacgcctgtaatgacaggttctgaagaagagaacgcctttacatcattcaagttacgtggagcaatctgtgcagcacttctgtacatagtagccacaccagtcaaatcgcccgttgcttttgtataagtctgacctgcaaatacagagccagcctgacaatatactgttatgttggttccatcagcagtaaacgtatgagtatcatacttgtcggcagtacaccaagttcctgaaccgtctgaagaaacattcttaatagtaacagtcatagcctgataggcagccagtttatcggcagtaatgacaatcggagtaacgtttgccgttccaatcttctctactttacaccaagtttcatccttagaaccggtaacttcatacagtccgctataattctgaaccttagcagcacctttcattaatgtaactttcactttatcacccatcttcaaccctaaagtcttaggatcaacctgactgccataaagagtcacaccgttcttttcgcttgtagcaccctctactgcaacctgcaagttgttggttgtatagtttccactttccacgtcagcctgtactacagcttcgaagaaacggtctgcattggcatcaatcactgcacctgtactcatcggttcaggcatcaaggctatcaattcaggaattgtaatggcagtagcctcacccggttcaaccacagaaccaccttcaaggtcgacttcctgaccaccgtttcctgtagccagtgtgatatcatccagacgatatacagaagattcgtttgctgtaaagcggatatacagttcagaagcagccttcttcagtgtaaagttggcagtagcaaaaatccagtacggagtttcagtatctccgttgttcttttcgtaagcaatttcagtccatgcagtaccattggcactcacttcaactttgaacttgcttgtatcgaatgtattgtcatgctgaccatcatctcccatgcttgagcggcttccaccgaaagtcaacttcaagttagtctgtccttcagccaaagcgattttctggatatcgaaagtagcaggtgcaccaccaaagaataccacgttcggacctgaagctccttcgtaagcatccgtattggcaagaccagacgaacgtacagtcgtattattgccggcataagttacatttgcagcaccatcacccgtcttgttccatcccgtataacctgaaacagatggtttaccagaagcatccgcattaccaactgtttcgctataaagaactttggattcaactaccacaccactcttcactgtcacggtagcagttttcaacggaccagactggttaccgatagtgatattgatcttagcctcaccgtttgttccttcaggtacacttacctgaacggtagcagatccctcaccagaagtctttgaaagagtaacccaattagcgttatcttccacagtagcattccatggacggtttgtagaaatatcaaacgattgagtaccgccattctcaaatgtcaatgtagtaggatcaacttccagataaggagcttctgtatcgtcattatcgtccacacaggcagtaaacgagacagttagcaccatgagcagcagcccataccaaaaacttaaagactttaattttgccattttgtttttcattaaaagttaatatgcattttcactagtcaaattattattctaacatctaaaaagtatacagcaaacaaaattaatccagcatatccttttacaccaatcaactgcttgcttacccctaaaggggaaacaaatataataaaaataattaaaaatcaggttcttaattcaaaaaatattaccacattaacgtcgttatgttaacgacatttattttatcaataaataatattatatagtatgacatccataaagaaaaaaaacagcgtcaaaccatataaacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgcatataaataaataacactatttctaaaaagcagagtataacgttataaattatcaggtcagattaaaattaatcaatatgaaatatcaccaaccaaattatgatttatatcactttctcaaaatctcataacccggcaatccataaacgacgtatgatagactttctttgtcccaccagacaatctttcctgacaaaaatccataattttacggtcagtcccaatcagtattctcatctttttttaataaaaaacactaccgtcggcaaatgatcgctatatccgttcatccatctgcctcctgcctgtgttcttaaagggtaacctttatatttaccatccgcttgtataagaaaatcgcgtctaaagatttcatgattcaaataactcaactttttatgtcgcttattcaaaaaattacctgtaaaaacaatctggtcgaacaaattccatttgcctctatattttaatgttccttcaccttcagctaatgtattccaccaaggattatacaaatcacctttctttacattcttcatgttacgttttgcccccaaggcctctgccatactcttatccataggatcatcgttcatatcgcccatgattacaattttgattttcgagtccagacgctgcagtgaatccttcagcgcacgtacttgcatgccagcacgttcgcgagcagaggatgctgctccacgtgacggccaatggtttacaataaaagctacacgttcgccagccaatctaccatctgctattagaaaacctcgtgtaggacgatctgtaggctgggccaatacataaggaaccagtttggtagctgtcaccgtgtacagctttggattataaaagaaagcacaatctaccccacgttcatcaggcccttcataatgaataatctcatacccccgattggccagtgcaggctgctttaacaaatcttccaatacatggcggttttcgacttctgccatacctattacagcggccccttcagaagtcttgtcagtagccagtaaaccaagtactgtcgacatatttttcagtttcgactgatattttgtattatcccatttgtttcttccttcgggtaaatactcataatctttcttaccctcatcgtgtattgtatcgaacaaattttcaaggttataaaaggcaactccgtaaatattaccattctgctcttgagcgtaaccagtaatagccagacacacccagaaaaacgtaaacaaatatttcttcatatcaaacattacttctacagataacagagggactgaacgtgaacaatcacatccaatccccctctattattaaaaacaaatctatcactatcagagttttacaggatctcctgctatctcaaactgtcctccacccagactcttataacggaattcatacgaataactggttccatcgtaaaccactgcttgcattttataatacaaatctactccgttcatctgcgtaggagcatccggataattatgagaaagaaccaatccgcacgcaacctgaatctgtttcatcagatacgcttctgctttctgttcatcttctttgtccaccaatccttctggatcatttccggtacgtttatacatctgtatattaaaattcttataatgagaagatgcgccaaaccaccactctcctgtatctggataatctttatccaaataagcgggtttgttttctgcaacccactttacaagatactgataatcgtcaacagtcatcgaaacagtgatagtaggatcgaacaaccatttttcaccattatgcaaaaacgtttctttttcatgacggacaatattattgttcagtttccaagtagtatccaacagatattcatctgccatagcaacagttgttttgccatcataatatttatataacacaacttgtgtatctccctccttcgcataaggtaatttctgagccagaaatacaggtaaatagtcggttgccttgatagaagaagagaaattatcattctttcccggatcacccattgcatcataatcggcaggagttaccactacaacatcgttaccgatataagctccccacttaccgcttgtgaactggaacaatgtattataaggcttcgattgtgaaggttgtgaggtcgtaacttttacattatccaactgaatggtcgtcgtaactccatcctttgctccccgatacccgaaggcaatataaatatttttcccattataggacttcagtgaataggtcccaacatttgttttatcagtatatccgctttccattggagtaggataagcaaaataatcagtaatatcagtccatgcagatacatcaaatgctcctcccgcattatatttatcagaaatcaatacgctgaaagcatctccgttataatgaccgaatactatatcaaaagtcaataaagcatctgccgattctatttttaccggtttcgttatcaagtaattttccacttctccagcagccttgtaagcagacagttcagccgatccatcgcccttatatacatttgccgaccatttttctgttccttttacacagacctgtgtccattctgcaatttcaataggctgcttagcagtgcacgaattgaaattctcatttaaataatcaattccttccaccggatcattcaagtcatacatataatccgccagacaaaaatcaccctccttggcaccttccatacgggcagctaatatcttaggaatttctacattgggagcatgagaaggagataaaaaattattctcccatatagttttgtaatcatctccatttaaggtataggcagacacaacagaatattttttcaatgtttctgaaacatcttcctgataattatatgtaacccctacagtagaaccttttccccaagatccatacagattagccaatatagcaggaacatacttatctgccgaagcaaaagaattcagagccaaatctgaagctactcgtttcgccaatgacttttcttcatcagtctgtgcgtcagcttctgccgctttggctatagattcataatcagcctttaccaagacatattcttcttcagttttcgtgatggtaataccttccgaatcaatttcattgtaaatatcttccatcggattacatgcaaccagtaagccaccaaagaaagacaatgctattaaattatatttcaatttcatacctaaatcatgttttaagttaaccatcagaacattaccttaaatccggtagaccaagttctgccgaagccataaaataccaaagctgaatcccagttatgagttgcaccatctgtagcatcagccacataacaagtatttgtcaaattgtagacattgctataaatcacagccttcaagcccttgcacaaatcaaagcgataactaagtcctaagtcaatggtataaaaattaggcattttccaagaatcaatgccggcatccgatttactggtacggtttgacggatcgaaatcagcatagttcttacctgcaaaattatagtcagcattcagtttcaatcctttaaacacctcccatgaagcagacagtgcagcagtaagctgtgctgagttgcccacatgtacatcctttacataagcatcgtatgtaccgattggcttgcttgactcatcgtaaatagtaaaatgcacatcatccgcccatttccagtcacctaaggagaacatacctttcaattcgaatgtcttgacaggcttgtaagttgcttccagttctactcccatgtgaatggcatccagacctgtaatattggcatattcctgtccaactcttctacgagtcgatttatccatccatctggtataatatccgttcagtgcgacattgaaatattcattgttgaacccatatcctaattcgaacgtaacaattttctcgtaaggagcatctgcattggcagaaacgttattgttcgggaatacagaattaaagaatggagcacgggtgaagtatcctccattgacaaaaacgttatggtttcgattaaacttataattatatcctgccttaacactccacggctggaaatgatagaaatcggaaaccttttttccatctacattgccgcctttgtcatgataacgataagattcgttcgtaatagaagcagacaggaacgaggaccatttatccgtattatactctgcctgtgcaaacaagcctgcccagacaatttcacctacgctatggtactgaacaatatcaccctctttcaggatcacattaggagattcataatccagatgcttactacccggcatataatatgcaccacccaacaaattgtcaatgacttctttgtgatagcctttataatagcgtccgtcgaatccgcctgtaaacgtaaatttctccgtgatacggtttttatatgagctcaaaacgccataccagtcatgatcattcacagcattggtaaaaattgcttgtgaaccgttgggattggaagcattagcagccaacacagcatcgtaatcaagtaatcctcctgctgtcagttttgtatcttcgtaagggcgtccactattattgtcgatcgccaaccagttactattatttccacgtacgcggcgtccaccaccggttgccatggaagcatacagagaagtcgtcaaagaagagttctcattgattgtccaataatgattcaatgaaacctgcggtttgtgataatagttatatccgtaagcgccaccagtcagttcaccattcagataaccataagagttactaaaacgtccaccatccgggctgttcttataatcttcgatataatgcttggttgcacgctgattatgccattgcggagcaccaaaagccgtcaacgacaatttatgatgttcattaatgatcttagagatattaccgaaatacgtccagccttcataattggttcctttcacgtatccatcacccgtattcagagcacccatcaatgtaacagcccagccgttatccatcagaccagtagaaacagaaacagaatatttacgaaatccgtcatttccgatgccgatataagccgatccacctttttgtgcttcggtactctttgtcaccatattcatagttcctcccacagaagacaaacccaatgctgaagctcccaaaccacgctgcacctgaataaactggctcacatcagacaagccagaccagttcgaccaataaaccttaccgttttccataccgttaataggtacaccatttatcagaatacccagattggaagaatcgaaaccacgcatattgattcgagaatcaccataacctccactatcacgagtaacatatacagatggagtagatttcaacaactccggaaattccaagttaccaaccttctcttcaatagttgccaatttcacattagaaatagggattggagtctgacgatcagacttgataatcgaagcaatgacacttacctcacccaaccctatagcgtcaggtgccaaggaaattgtacctaaatttacattatttcctgtaattttcacgttcttgattaattcattataaccaacgtaactaatagccaaaacaattttgccattttttacattcagagtaaaactgccatccatgtcagttactgttccttctgtagagccttttaccactaccgtcgccccgataagaggttcgttgttttccgcatctacaatcttgcctttcagtgtagcctgagctaccgcagtgactgtacttactatgacaagcaccgcaaacaatagaaaatgcttcaattgacttttcatacgttttcttcaattgtttttgtgttattaataacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtaataaatcaaagacaaatatagtaaaaaactttaaaaattcggaggaaaaagccaaaattattagcacattaactcgattatgttaataaaattattattaaaaatacaaagaatatgcatttccacccgaccagccgtttttataccgacactatcacgcagaaagcagtttttctctttacactttccacggagaaccgacgaaaaacttgtcattttatcagaagcataaaaatttaacagaaatgaaacacccctgcacgtagttgcgatttaagcaagttcacaccagcagcagacaggaaaaaaggagacaaaatagcaagcggaccgccgatggtaccaccaacggtaccacttattatactgctacacaagcaattaccactacaaacggcccaccaatgataccaccagtggtaccaccctttcctattatatataataaacaaagatataatcaaaggaagtttcgtccgaaacttcggaggagggcattgagaaaagaaaggcattaactttttttaagcccgcggcatcgacagacttccgcacgaggattctggcagaatttgtacaaaagattttagtttttgtacaaaaactggaaaatcgccacgtagtcttccggaaaacgcgcttccgatttccgccacgagccgtccagagcccgaaagaaagccgtccgaacacgaggaaaaccgcccgttttttcgtatctttgcaaagataagaacttaacccaaccaacgaatcatggcgaaagaaaaaaccgtatatgtttgcaccaactgcggacaggaatcgcccaaatgggcaggcaagtgtccgtcgtgcgggcagtggaacacgtttgtggaagaggtggtgcgcaaggaagtgcccgtagccaagcatgtggcgcacggtatcgagtcggtacgctcgaaaccccagcggctgcacgaaatcacctcgggagaggagcagcgcatcgacatgggcgacgacgagctgaaccgcgtactgggcggcggactggtagagggctcgctcacgctgataggcggggaaccgggcatcggaaagtcgacgctggtgcttcagacggtactccggctcacggacaagaaggtgctgtacatttcgggcgaagaaagcgcacggcagttgaagctgcgtgccgaccgcatcccccatcccgaggcaagcaacctgctcattgcgtgcgaaacgtcgctggagcagattttcacgaacatcaagaatacggctcccgacctggtggtcatcgactccatacagaccatctcgacggagaatatcgactcgtcgccgggcagcatcgtgcaggtgcgcgagtgttcggcagccatcctgaaatttgccaaggaaacgggtacaccggtcatcctcatcgggcacatcaacaaggagggcagcatcgccggaccgaaggtactggagcatatcgtcgatacggtgcttcagttcgagggcgaccagcactacatgtaccgcatcctgcgaagcatcaagaaccgcttcggaagtacggcggaactgggtatctacgagatgcgtcaggacgggctgcggcaggtgagcaatccttcggaactgctgctcacgcaagaccatgagggcatgagcggcattgccatcgcctgtgcggtagagggtatccgtccgtttctcatcgaggtgcaggcactggtgagcacggcggcctacggtatgccccagcgttcggccacgggattcgacctgcgccgcatgaacatgctgctggcggtgctggagaagcgtgtgggctttaaattggcacagaaggatgtcttcctgaacatcgcaggaggactgaaggtgaacgatccggccatcgacctggcggtaatcagtgccatcctgtcgagcaacatggacacggagattgaagcgggcgtgtgcatggcgggcgaagtgggactgagcggagaaatccgtcccgtaaaccgcatcgaacagcgcatcagcgaagcggagaagctgggtttcacacggatgctcgtacccaagcataacctgcagggactggaccgcaagaagatcaagatcgagctggtgcccgtacgcaaggtggaagaggctttccggcagttgttcgggtaaaagagtgctaacaagataatttatggcaaagaaattcaacatacgaaacagtacggcagaatttctcattttccaacttgaaggaaaagagaacggtatacaagtgctctataaagacgaaacaatctgggctacgcaaaaagcaatagccgagctgttcgacataggagtgccagccatcagcaagcatctgaaaaatatattcgaagacggtgagctgaatgaaaattcagttatttccaaaatggaaacaactgcctccgacgggaaaatgtacaacacccggttttataatcttgatgccattatttccgttcttcgaccgcttcaatacagacagcttattatcatttaaacctgactctgattcatagtaaacaaaaacaaccatttatgatacaagaataccagttaagagttctgcccgagcaggcagccagcgaacagcatatcaaacaatacgtgagccgcgagaaggggctcgacattcgtaccatccacgccgtacgggtgctgaaacggagcatcgatgcccgccagcggaccatcttcgtgaacctgaaggtgcaggtgttcatcaacgaaacgcctaccgaggaggagttcgtgcggacggaataccgcaacgtggagggtaagcctcaggtgattgtggtgggtgccggaccgggcggcctgtttgctgccctgcgcctgatagagctgggactgcgtccggtagtggtggagcgcggaaagaacgtgcgcgaccgcaagacggaccttgcccgcatcagccgtgagcacaaggtggacccggaatcgaactacagcttcggcgagggaggtgcgggagcttactccgacggcaagctgtacacgcgcagcaagaagcgtggcagcgtagacaagattctgaacgtgttctgtcagcacggagcaagtacttccatcctgatagacgcgcatccccacatcggaaccgacaagttgccgagggtaatcgagaacatgcgaaacaccatcatcgcctgcggtggagaggtgcacttccagacacgcatggatgccctgctcatcaaggacaacaaggtggcgggcattgaaacgaatacgggaaagaccttccacggtccggtgattctggctacgggacattcggcacgcgacgtataccgctggctgtatgccaacggggtgaccatcgaacccaagggtatcgccgtaggggtacgtctggagcatccgtcgatgctgatcgaccagattcagtatcacaacaagaacggacgcggaaagtatctgccggcagcggaatacagcttcgtgcagcaggtagacggtcgcggggtgtacagtttctgcatgtgtccgggaggatttgtggtgccggcagccagcggacctcatcagatagtggtgaacggcatgagccccagcaaccgtggcacaaagtggagtaactccggcatggtggtggaactgcgtcccgaagacctgctcctgcccgacttgcagcttcaggcgtgcgaaaccattcagggttcggcagaggcacagaccgaggaactgattgcccgttcgggaaaactgcccgagggaagcgtacatacactggctgtaatgcactttcaggagaagctggaacaactctgctggcagcagggtaacatgcgacagacggctcctgcacagcgcatggcggacttcatcaaccggaaggtgagctacgacctgcccgacacatcgtacagcccgggactggtttcttcgccgcttcatttctggatgccgaaattcatcagcagtcgtctgagccggggcttccagttgttcggcaagagctcgcacggcttcctgaccaacgaggcggtgatgattgccgtggaaacacgtacctcggctcctatccgcatcgtgcgcgacaatgaaaccttgcagcacgtcaccgtagaggggctgttcccttgcggagagggtgcgggctatgcaggcggtatcgtgtcggcaggtatcgacggcgaacggtgtgccgatgccgtagcggcgtacttgcagaggaattaatctcacagcatccttataaactgttatcagtacccgataaaatgaatagttgcagtatggtttctgtaaataagcagtagcacctaaatgtgcaataatcaattacctatcagcgaactatcagtaacttaaaactttttaccggatagtaatcataaactttattcaattgcgtccgcactgcggtcgcaattgaactgaacacattataaatcgatagataaacgagcaggtacaacagacgaaggcagatccatatccggacgaaaaagagtgaaaaagagaaataaaagcagttttgagaaaactaaaagccttcttcaatcgtttctttgatataagtattcctccgacatgaatcaatgaacctgtgtgaaaaacataacctataaccaagatgcaacatatgcctgaaatagcaatcgtagaacagaatacgctgacagcactaggcttgcagaccattctggaagaacttatccccgtagcgaccatccgcagattttcgtcgttcgccagactgatagacgacacgccggacatgtacagccattattttgtttcggcacagacgtacttcgagcatacgtcgttttttctggaacgccgtccgaagaccatcgtgctggcagcgggcgaacagcctctgctgaacggtgtccctaccctgaatgtctgtctgccgcaggacaaactggtggcttccatcatgcagatgcgaaaacagggacacgaagcgacacatcatccggtatctccgcaagaaatgcagcagagccacgatctgtcgccccgtgagatagaggtactggtactcattaccaaggggcttatcaacaaggaaatagccgacaagctgaacatcagtctgacgacggtcatctcgcaccgcaagaacattaccgagaagctcggcatcaagtcggtttcggggcttgccatctatgccgtgatgcacgggtatgtggaagctgaccggatatgatacgacaccggtatgtgcctgctctgttgattgtactaatctatcgccactcttgcatcgcaggctatcttctggcattaccttcctaacgaatacaggcggaaaggtagatctattagatcgacaagggcttgccggaggaacttatcttgtttttcttaactataaggattaatttcaagtgaatgaaaaatttactatatttgtattcgttgatacgaagttgattacaaaatcaattactcttctatattcacattcaaataaagcatttatgaaaaagtttcttttatttgtattggtcggtgagtgttagctcaagcaatattaatcgtgtctatcgcattaatacaagggtatataggttatagaatgtacagaacaagataataagcaaatcaatttaattattcaatttatgaaaaacaacaagatcatcggttggacgatattatgcctgcatgctgtcatcttattcctcatttttcagtttgatgttttaggagagtggagaagcggaagtctgacaatcagtcttttcaccctatacacgctggcaactccttcgctggcgtggtatttgatcaataaagagggaaaatcacataatatgtaagtaatagcttacatgatatatgttccaatagaacaacttgattgaatccaataattttaaatataaaatgatttcatacgaaagtaatttttatccttacatgcaataaatcaatgatgttctcaaacgaataaaataagagaaaaaaggaaaaacaaagttgaaataaattagaaagaatttaaaactattgaatacataatatacaataaaagcccgtcggtcattcagtgccattcacttcatcaccgacgggctttttcatagcttatatttccccatcttatttctcagccggagcagccgcttcttttgcctgcttcagcttctgttcgataggatccttatactgagtctggagtttcaccagttcagccttcaggtcttctgtaatcttctcataacccggctgaccgtagatattgtgcatttcggtcgggtcttccttcaaatcgtacaattcccattcgtcgatgtcgttgtagaaatgaatgagcttgtaacggtcggtacgtacgccgtagtgacgttttaccatgtgttctgccgggaactcatagaagtgataatacagcgacttacgccagtcggcaggcttctcacctttcagcagcggaaccagagatacgccctgaatatcttcggggataggtgctccggcaagttcgaggaaggtcggggcatagtcgatgttctgtaccatctgaggaatttcacccttcgccttgaagtctttcggcaggtgcatgatcagcggggtatgcatggattcctcgtacatgaaacgcttgtcgaaccagccatgttcgcccatgtagaatccctgatcggaggtatagactaccagcgtattgtcgagcatgcccttttccttcaggtagtcgagtacacgacccacattttcgtcgagcgacttcactaccttggcatagtcgcgcatgtagcgctggtacttccattcggccagttccttaccctgcggattcttcttgtagaagtcgtcgataatcggctggtagaagtcatcgtacaccttacggtcttccggactcaggcgaccgatataactttcgtatctttccttcagcggagaagtcttgtcggcacggtccatcttgttgtcgtaaatcaggtccatgttcttccagatactcatttcctgagcagcggcagcgggacgaccttcgtagtcatcgtagaaattgtcgggcaacgggaaggtcttgtcctcgtacagcggcaagtcttccagtgcaggcagccagttgcggtggatagccttgtgatggataaacagacagaacggcttgttcttgtcgcgctggttctccatccagtcgatactcatatccgtaatcaggttagtgacatacccctccttgcggatggtatcgttgtccatcgtgatgaaatccggattataataatcaccctgttcgggcaggatttcccaatggtcgaatccggtaggcaggctcacgaggtgccattttccgatgatagccgtctgataacctgcctgctgcaacagcttcggcatggtctgctgagaaccgtcgaacacacacgtagtattgtcggtaaatccgttggcatggctgtgcttgccggtaagcatacacgcacggctcggtccgctcagcgagttagccacaaaactgttggtaaagattacaccatcgttggcgatacggtccaggttaggagtttccacaaagcgacttccatagcagctcatcatctgtgccgtatggtcgtcggtcatgatgtacacgatattgtactgtttgggagcctgtttctcactgccgcacgaagccagtgaagccagagctgccatacccgtcaacgggtaaagaaatgaagatgttttcataaaatgaaatgaggtaagtgaaaaattatactacttattacaaagataccagcttcgggaggatacccaaagccatcaagcaaaaaagtccgaggaagtatggcatttcgtataaacgtttaacaactcgtacacaaaccttttacttccacaccttattggacatctctccattgtgccattctctacagctattccttcagtgttcaccatctgtagatagcaagttctggctgtaatttcaacaaacagcacttgactaacacagtcctattaaaaataatacacaaaaaatattacaataatcaatatctaatttaaagattaatacaaagatagatataattttaaaaaatattatatttgcacaacagaaaacataaaaaaagacaactaaaaaagtattactatgaaaaaaaatccggtaaaagtatgggccatttgcctgctaacggcaggatgtctgatggcgtgcgcgccacaagaaacccaaacgggtaacctgaatatcattccactaccccaagaagtaacggaaaatccatcatcggcacctttcgttatcaagccctccacaaccatcgtctatgaggaaagtaatgaaaaattagcaagtaccgcccgtcttttagccgattatattaaagaggtaacagggacggaagtcaaaacaggcggtcaggcaagcaagaactgtatcatcctgaaagtcgatccgtctatgacacacaaagagggatacgacctgagcatcactgccgatgccgttacggtaacgggagctaccgaggccggagtattctacggctgtcagaccatccacaaggcactgcccattacagagggcaaagcactggcttcgctgcctgccggagaggtgaaagacttcccgcagtataattaccgtgggttcatgattgatgtaggccgtcatttctttccgaaggaatacctgaagaaactgattgatgtcatggcactgcacaacatcaactacttccactggcatctgaccgaggatcagggctggcgtatcgaaatcaagaaatatcccaagctgacggaaataggttcgtaccgcaaggaaacgcttacggcaccgggatcgggcaagttcgacggtactccggtaagcggttactacacgcaggaggatgccaaggaaatcgtggcttatgcagccgaacgcttcatcaccgtaatccccgaaatagacatgccgggacacatgctggctgcgctggcttcgtatccggaactgggatgtacgggtggtccgtatgaaacggctaccaaattcggtgtgttcaaggaagtgctgtgtggcggcaatcccaagacattgcagtttgccaaggatgtggtaaacgaactgatggatatcttcccggatgctccttatatccatatcggaggcgatgaatgtccgaaagcagaatggaagaagtgtccgaagtgtcaggctaagatcaaggaactgggactgcgtgacacgaaggagcacagcaaggaaaaccagcttcaggtgtacttcatgaacgaagtggaaaaggaaatcgccaaacgaggcaagaagatgttggcatgggacgaaatcctggaaggcaacccaaatcctgcaacgactaccgtcatggcatggacgggcgtaaaggcttccatcaaggctgcacagctgggacatccgaccattgtctgccccatcagtcacctgtatttcagcaatccgggctataaccgactgaagggtatcagcagcgtggaacgggtatacaactttgaaccgcagtctgacaaactgactccggaagagaagaaaaacattatcggcgtacaggcttgtatctggacggaatggacgaaggacagtctgaagatggaatggcagatgatgccacgtatcgccgcactgagtgagttgcagtggagcaatccggccaagaaggatttgaacggattcctgaaacgtctccgccaccaactggatctgtatcagctgtatggatgtaattataaaaaggatattgaggatgtaacgattgacgtggaaccgaagggaacagatggaacggcagttatccaactgaagactttcgacaacgcaccggtttactatacactggatggttcggaaccgtcggcaacctcgcagcagtatacgcagccatttacgttagacaagaccacgaccatcaaggcaaaggctatccgcaacggacgtgagagtgatgtgactgccgaaacactgacatacaacctggctaccatgcacccgattaccctgaaatgtgagccggatgaaaaattcacttacaagggtgccaacttgctggtagacggtatgcagggagatgacaactaccgttcgggacgttacatcggtatttacggtcaggatttcgatgcgaccatcgacttgcaggagccgaaagaaatttcttctgtatcggtcggtacctatctggttccgggcgactatatcttcggtctgacaggactggaagtttatggttctgaagacggcaaggcttacaccaagattgcttcgaaggctattcctactctggaaaaaggcagcaagaacaacgtactgaagcgagataccctcagcttcgacaagacgaaggcacgttatgtacacatcatcggaaagaatactccggtacttccgaagtggcatccgggtgcaggcagtcagacttacctgttcctcgatgaaattgctatcaactaaaaataataaacggctgccgagataagatgcagccaatattatcataaaaaaagagtcatatcatcctttcatacggagagtttgatatgactcttttctatgataactaaatcaagagataaaaaaacatcgggacgttttcccgtaatcatcgcctgatatttttttgcataatcctcataaattaggattgccggataacgggaattggcgttactttgcaaccgaattacaaaacccactagacagattatgaaacgtacaattctcgcttcgctggcaactgccgtgacgacagtcgcctttgctactccgaccgatacagagattgcattggtcaaggacactaccaaagttatagacatcgaagaagtggtggttatcgccactcccaaggaaaataaccgtctgcgccagcaggccatttcgtcgacttcgctctcacagaatgagatgcgcaacaactcggtgacttcggttaaggcgttgtcgggacttgtacccaatctgtttatccccgattacggttccaagctgactacctcggtgtatgtccgcggtatcggttcgcgtatcaacacgcctgccgtgggtctgtatgtcgacaatatcccgttcatcgacaagtcggctttcgacttcaactattccgatatcgaacgaatcgacgtgatgcgtggtccgcagggaacgctgtacggacgaaacaccatgggtggactgatccgtgtatttaccaagtcgcctttcacatatcaaggtacggatatccgtctgagcgcagctacatacaatgactataaagcctctctgactcactaccaccgtatttcttcgcagtttgctttctctacgggtttcttctacgagcacaagggaggcttcttcaagaatagtttcaacaacaagcgcatcgatacggacaatgagttcggaggtcgtttccgcgctatctacctgcctacagacaacctgaaactggacctgacggtgaattatgaatataccaatcagggaggttatccgtacgaatacaccggacgtaccgacggcaagacggaagatcgcagcgactatatcggaaaaatatcgtataaccgtctctgcggttacaagcgtaacttgctgaatgcaggtctgaatctggagcatcaggcagacaactttatattgagcagtgtgacaggtttccagtatctgtacgaccagatgaatctggatcaggatttcaccgaagcagacatctataccatcatgcagaagcagaactcgaaaaccatcagcgaggaacttgtattgaagtcgaagccgggcaaccgctggcagtggactacgggagtgagcggattctatcagtggctgaaaactgacggtccggttactttccaggaagaaggaatccagagcctcatcgaggataacatcaacgcaggactctcgcatctgcctgccggagcacctactttagcaaccaaaattacgacacgacccttgcccatttcgggtgtgttcgatacaccgattttgaacggtgccatttaccaccagtctacgttcaacgatgtgctggtagaaggtctgtcggttacggctggtctgcgtctggactacgagaagctaaagctggattacaactcagtatgcgacatgaatttcgatttcagcgtatcggctcctttccttccaacggcgattgtccgaccgctgaatgccaagacgcagttcatcggcaaggaatcgaccgactacttgcagttgctgcctaagttcactattcagtacgcatggaacagcaagaacaatgtgtatgctaccgtcagcaagggataccgttcgggaggatacaacattcagatgttctccgacctgatacagaacaacatgagaaacgatatgatgaatgccatcaagcaggacgaggtgctcggcaagtttgccggaatgatgccggaaatgccggcttcggatgtcaacgtatcggatgctacgctttacaagcctgaatactcatggaactatgaggttggttcgcacactaccttgttcgacgacaagctgcaagccgacgttgctctgttctacatggatacacgcaaccaacagatttcacgttttgccgaaagcggactgggacgtatcacggtcaatgcgggaaagagccgcagcctgggtgccgaagcttccgtgcgtgcacagctgaccaacgcgttcagcctgaacggaaattatggatatacctacgctacctttaccgactacgtggtgagcgacacagagaactacaacggcaactatgtgcctttcgttcccaagcacacgttcaatgtaggagcacagtacgtgttcacgatgagaaagggtgctatcttagacaacattacggtgaatgccaactacaaggctgccggacgcatctactggacggaacagaacaatgccagtcaggcactgtacggcacactgaacggacgtgtcaacttcaacaagggcaacggacagctggctttctggataaataacgcactcaacaccgactatcaggcgttctacttcgaaaccatgaacagaggctttgcacagaaaggtcgtccgcttcaggtaggtgtggatatccgctgccgcttctgatgccaacctcaaactccataaaccaaacggacaacaagaggtgtcgaacgaagttttatacaggatattataagtagacttatgctttatataggaaattaagcattaaagaaaacatttcaaaaaatagaaacttaaaagcaaagcatcctcctgtctttggtcccttcacaacgaaggctaaagcaggaggatgctttttatagattgcccatgttcgcgtttcagctccggttccttttaatccggttctttttgaaaggtgcagggtttctcctcagattacgattctcgctgtgtttctgatagccatatcttttattttgagaatcacctcaatttcagattcaatttaggtcataaacttttgtgacataatcttaaacgatgcgtacaaaatcattatttttaggtatttcaaaacttctccatacaccgttactttacaatgtcaaatcaactaaaagtataaagcaatgaaaaagactggtgtattttacggttctacaacaggcacaaccgagtctgttgcacgcatgatagcaaacaagttaggaatttcttccggcgatgtatacgatgtaagcaagctaactgccgatgtggcagggagctacgaagcgctgattttaggaacctctacctggggcgacggcgaattgcaggacgactggtacgacggcatcaaggtcttaaaagggatggatctttccggcaagacggttgccctgttcggatgcggtgactcggaatcttacgccgatacgttctgcgacggcatgggtatcttgttcaacgacttgagagacagtggctgccgcttcatcggtgccgtttcggatgccgactatacttactgttcttcagccgccgtgaccgacggatgtttcgtggggcttgctatcgacgaaaccaacgaaggcgacaagaccgaagagcgtataacggcatggacggaaatgctgaaaaccgaacttgcctgaaaccaacctccggacaactctattagtcattccaaacaaccactcccatgaaagtaaccgaaatcaatcccgtagaactgaaagtgtttctgaaccacatctatgaatacaagaaaggtgtgcgtcagatggtgctctacaccaccaacaagaaatacgaaacatttgccgtaaaccggttgaaaagccagcgcatcccgttcgtgattcagccggtagacgaggaacgcatcaacttgtttttcggcaaggcggaatgtatcaatgccatccgcctgatggtaacccggcccttgaacctgctcagtccggaagaagatttcattttgggagccatgttgggatacgatatctgtgcacaatgtaaacgttactgcacacgcaagactcgcacgcgtgtggcgaattaacatcatcttgcctattcattcagtgcaccacaatgcggacaaatgccttttgtccgcatttttgctccacaggctccacatgcatacggatatttgtccgacttccgcaaacggtcgatacaccataccgtgtaggctatcaggcagacataggcagcatatacccagacataggtgaagaatatatacaggaaaatacagtacgcagccagtcccaccagatagaaaaacgcgacttccaatttcgtctgatggaaaagatcatcgagcatggctacccccaccagcagaatcagtcccacacaaacgatgaacagtcccaagatgaaaggtacgtcaaacggattcagcgtgggatcgtagtaatagtgcatccatgtttccggcacgaaatgctggatgctgttgtagagcgtagccgctatcgccatcagcagcgacaaagtaatggggaacgcactgtcgatgtcattcagtccgatcagcttgatctgtttcttccgtatcgcccgatagacaaaccatacgcagaacacggccataatgagaaagaacggcaaggtatgcgagttgctgaacaaatggatgaactgcgaaatagggtcaaccggcacgatgtgttccagcagttcatgctcctgaatccagccgatggtttcctgatcgcgtgccaccttcacccataccgagtccactgaatcctgaagatggacatcaaactccgctaccaccagctgatttcctctgacgacaggtacactgtccataaacggtaactgatgcagccataaggtatcggcctccacctcgaagttactgctcagcgcatacgcccgttcgggcacgacagccggcagcgagtcagtctttccgtcggcaggcatgtctgtcgaagccgccggccgatagtggcaagccacgataccgaccagcaacaagaggatcaatatatatttactcttctgcatatactttcatctgacactgcttacagtcgaactgcaagcggaaacgtctgccgtcgccgctgaccagaaaatacggttcgcggtaaggcgagcgtaccttatgatgtaccggacaccaccccatgctgtagcgcaggcagtgcttgcagaacatcagcacagccttttcaggagcttctttctcgaatgccggtgcaatgcgccgtactccgtggtcgtgatagaaagcggcagcggcaccgttcatcacattccccaagtacgtcagttcctgaaccggaaaggcatgatgggtttcaggcatacgccaaacctcctgcggatagttgatgcgacgagcttctagcagcttctctaccgcccgacgacgcaagtcggacagttcggacgaaggaataaaccagttgtccgacaaggctatttccacctccgtagcctcgaacggcgtatttcccagcttactcaactggttcttcaggttctcctgctgaggagtacgtgccagttccttttctctgggcaaggctatgctgatacggttctcatcctcatcggcaagcgacagggtaaagccgaaattattctcttccagcctcagcatcacggcgattttccgttcggccgacttcttctgcatcacccgttcaaactcctgatcgaagttacggtaaagtttggtcttgggctttacacgcggcatctcctgcggatagagtttgttgccgtccacccggttcacacggaagccgcacaacttgccccgttcgtcgagataacacaaaccgtcgccgttgctgaacgattttactcccgctaccgtgaggtaattgccccgaatctccttgaccgttccaacctcctcgcccaacgatttcggtgtatcgaacgagaaaatgcccggattacgtccgtgcgcgaaatagtcggtaaagccacggctgaaactcttgtccagctgcggacggaaggcgagcttcaccgttcccgacgaagcacgtgtatattccttgcgacgcttcaggatggcatccagtttctgacggtagtacgccgtcacgttctttacatacgatacatccttcagtcgtccttctatcttgagcgaagaagcccctgcatcgagcagtgcctccagattctcactctggttcatatccttgagcgacagcaaatgcttgttgcgcgcaatgacttttccgtcggcatctaccatatcgaagcccaagcggcagaactgcgcacactctccacggttggcactgcggccgaagcatgcctgactcacgtaacactgtccgctgtaacttacacacagcgcaccgtgtacgaagacctcgagcaacgtatcgggacaggcagcatgtattttggcaatctcatcgaacgtcagctctcgtgccagcaccacctgacggaaaccggcatccgccaaaaacttgaccttctgcaccgtacggttgtccatctgcgtactggcatgcagcgggataggcggcagattgagccgtgttattcccatatcctgaacaatcagcgcatccactccggcacgatacaaatcccagatcatcgcttcggtgtccttcagttcctcgtcacgcaggatcgtattcaccgtgacataaatacggacattgtacacatgcgcatactgcaccagtgcggtaatgtcttccagcgaattgccggcagccgcacgtgctccgaaacggggagcaccgatatacaccgcatcggcaccatgattgatagcctcgatgccgcactccaggttctttgccggagccaatagttcgataggacgttgtctgatcattactttatctgattaatatcgtatggagtttcctgatatacataatagttcagccagttggagaacagcaggttcgccgtactccgccagcgtaccagcggtcccttttcagggtcattgtcgcggtaatagttcttcggcatgtcgatgggcagaccttttcccaagtcacggcgatattccgtatccagcgtataaggagaatattccgaatgaccggtcacgtaaaactcacgtccgccacgagccatcacgatgtgtacgcctgaatcgtccgactcggaaatgatggtcagctcaggatgtttctcgatgtctgcacggcgcacctccgtatggcggctatgaggcacaaagaacacatcatcgaagccgcggaagataggcagcttgctcatgccctcgcagatatgatgttcgaagataccgaacatcttcttgtcgagcggatatttgggaatcccgtagtgatgatacagtcccgcctgtgccgcccagcagatatagagcgtagaagtgacgtgcgtccgcgtccagtcgaatatctcctgaatctcgccccaatagttcacctcctcgaaatcgaggtgttccaccggcgcaccggtaatgatcattccatcaaatttctcatctcgcatcaattcgaaatcgcggtaaaacgccttcatgtgttcgatgggcgtattcttcgaagtatggcttttcagcttcatgaaactgacctcaatctgcaacggtgagttagacaacaggcggatcaagtcggtttcggtagttattttcagcggcatcaagttgaggatgacaattttcagcggacgaatatcctgcgtactggcgcgggaattgtcgataacgaaaatgttttcttccttcagtaagtcgatagccggaagtttgtctggtaaattaagtggcatttctttatgaattaattgcaagtgcaaaattaggaaataaaaataaaatctcccttattctttcaccggaaagactatgagagcgaacagattatttgtacaagaccaacagtgcacaaacaatcatacccggatacatctcatatgtacatgccagaaataaaaacaatatttacttttgtattcatttttccctttctttgtataagatacctatcaagattgatattcagtttattgccttgtaagaataacctttcaaaaaaaacagactatggacgcaaagaaaaaatatctgtcacggttacaagcccggcttttgcggctgcttgttaccttgtttgcgacaacctttgtgtatactcaatattcgaacgattccattgtagtagatacattggcttcgggtgaacctgtttacgattggaggaaagtggaccaaaagccagagtttccaggaggagaagaagcattattaatggattatctattatgcccctcgactctatataacaataattatactctcttcgcagcacaaacgaacgctcacaagcttgcatatattgaaaaattttacgaatattgcacataagtttgccgataacctaatctataagcctaaactaaaaaaatctataaacctaagtatctatacagctacttatacaatattaagattcaatgaaaaaccttctgttcatatccttaagttgcctgacctttacagcctacggtcagaccagagaatttgccaacaccatcaaagtagaagattccgattcgaaggaagtaatcctagaaaaagcagcacatgtcgtccccacagccaatcagttgcgttcgctggaaaacgagttcattgctttcgttcatcttggtcccaatacatttacccgcatggaatggggaaccggcaaggaagatccgaaaatcttcgacctgaagcagctggataccgaccaatggtgtgaagccatgaaagccgccggaatgaaaatggtaatactgacagtgaagcatcacgacggctttgtactatggcagagccgctataccaagcacggcattatgtctaccgacttccagaacggaaaaggagatattctgaaatcgctgtcggcttcctgtaagaaatacggactgaaactgggtgtatatctgtcaccagcagatttgtaccagattgaaagccccgacggattgtacggcaacctgagtaagtatacgatgcgtaccattccgcgtcccgtcaaaggccgccccttcaaaaacgagaccactttccagttcatgctggacgattataacgagtatttcatgaatcagttgttcgaaatccttacggaatacggcgacatacaagaagtatggttcgacggagcccatcccaagcgcaaaggaggacaacgctacaactatgccgcatggaaacagttgatcaaagccgtagctcccaatgcttctgtattcggacgggaagatattcgctggtgcggcaatgaaggtggcaaaacccgagatacggaatggaacgtgattacctatccggaaaatcctgatactacatcttattttcccgatttgactgacaaggatttaggtagccgcgaagtcctatacaaaggcgattacctgcattatcagcaggcagaaaccaatacctctatccgcgaaggatggttctaccgtgacgatacacagcaaaaggtaagaagtgccgacgatgtattcgacatctacgaacgtgccgtgggtggcaactcgactttcctcctgaacataccgcctaaccgggacggacgtttctccgacagggacgtggcaacgctgaaggaagtgggccagcgcatccgtgaaacatacggtgtagacttgttgaagggcgcaagcggtccggcagaggttctggatgacgataaaaataccttcacgacagttgcctgcggagcaaaaataacccttacaactccctctcccatcaccttcaaccgtcttgtgcttcaagaagccatcgccctgagaggagaacgcgtagaagaacacgtggtagaagcatggatagaccgcaaatggaaagagatagcatgcggcaccaacattggctacaagcgtattctccgtttcccggatgtaacgaccaacaagattcgggttcgtttcacacagacacgtctggatgcagccatcagcaaaatatctgcccactactaccattcacgtccgccacagctgtcggcacaccgtgatgcaaacggcatggttaccattgaacccttgcgacaggaattcaactggaaccgcaacggcgagaacagtgcagacaacctgaatgcaggctataccatttactatacactggacggcacagaacctaccgcctcatcgaaggtttatacaggaccgttctttgcagataaccaagaagtaactgccgtttctgtactgaatgaccaaaaaggcgctgtatgcaaggaacagttcggatatgtcaagaaagactggaaagtagtacacgcaggcagtgaagacggcgagcatcaggcagcgtttgccatcgatgaagatccggctacttactggcagacagctccggcagcaaccgaccaaagtctgaccatcgacatgggtagtgtgaagtccatcaaaggatttgcctatactcctcagaaagtcaatcaggaaggtatgtttgagcgtggtacgatatgggtaagtacagataaccagaaatgggaaaaagcggatgatttcatgtttggcaacctgatcaatgaccctgtaaaacgttaccattacttcaaatcggaagtgaaagcccgctatgtaaagatcgaaatggtcgaatctgccaatcggtcgaagtatgcttcaattgccgaactggatattctgtaaaccgaaagtgatagcatagagaaaattcatactaaaaagaaccctgccatttctcctactatggaaagaaatggcagggttttacacttttcttcatctgacggatataattgccattattagttataatattgactggaggaaattcgtctatggatattaactgtaatactttaagttgattttttcagctgtaactgtttataaataagtacctatgaaagcaatacaaaactgcttacagaaaatagttatctataaaatatattctttagaaaagcaaaaaatggaatataatgacaatgaagtatataatcacataggagtaggttttttgattgtattctcatatatagtagttatattgctttttttatccgtacgattatttaatgaattgagaaacaattccacacttgttgtttgcgttacaatattatgtttttcggctaagtattttttcgtaaaacgcttaaaacaaaaaaaatatgttcaggcaattcacgaagaatatttacaaatggatctaaataaaagaaaggaaaactataaaattggattatattacgttatatttgttattttatttcctctattcagcatactagctatggaattaatagagtttattacggataattgattgaagtgctataaaattgtcatgtacaacactttgcaaggagcacttttcttctgaaaattaatagataccaaccgtgtaacctccgaacgaataataactcttactacagttttttgactagtcctaaataaccgttacagttattggacaaaaataaattatttatcacagttcagcaaggtcagtcttgctgaactgtttgtttttgtaacttttaatcttaatcagcttctgatgatgcatatactccggcgttttatacccacaagagtaatgaggtctgatgttattatacttgtagacagcatcccttattacctgtttcatatctgatagcggtagattaagttcctcaagcaggaactcctgttttagtattccgtttattcgttctgccacggcattagcgtacggatcgtaagattcagtcatgctgggtatgatgtgatattgtcccagtaatttctgatatgcatcggaacagtactgtataccacggtcagagtggtgtatcaatggcgtgtccctatacagtcggttgcggtttgccatcctcagcgcgttcaaagaaccttgagtgtccaaggaatcggaaagatcatatcccataatcttcttggaataagcatctgtaaccagagaaagatacatatgccggtttctattgccaatataagtaatatcagaaacccatatttcttccgggcgtgtcgcttccatactttctacaagattcttgtgcttccgaaaccggtgatgcgagttggttgttacatgatatgaacgtacgggctttataagcagacggttggcacggagtatatcgaacagtttgtccctgcctaccttgttctccttaagtggctgatgaagcatatgataaagtttgcgggttcctacacgtggcagttccattcggatatctcgtaccatgcccacaacatcagtggccctttgccggcctcggattatcttccattgctgacggtaatatttctgcctgcttatcccgagcagtcggcagattccgctgatacttacggatttttcttctttatatttattgactgttcgggagaggagttttttcgtatgtcgatattatattccttttccgctatgtctatcatcatgtcgaaaaactctgctttcatatccttcagctcaagctccttttccagacgggcattcttgcgttccaggaaccttactttctgttgtagttctaacagtttttgatccttactcttttccatagaatggtaacatttgtttgtgatatcaaagttaccatatttttcaatccaacggctaatagttgaacatccttgtatcccatattttcgtttcagcgctcccaaacttatttttgtggtttcatactcttgcactactgatagtttaaaggacatactgtaatctttttgtgtgcgcttaacgtactttgtttctgtcttttccataatgttaccttttttgttgtaacgctatttcaggactagacatttacctattaaaaaaggaaacaaaaaagaacttccatcccctgttttaattggaaatggaagccctacaatatctatttttcagaaccaaattgttacactgttagcaaacttattatactgaaaagctgtaacattattcatgtctatactataaatatatccctcatctgatgtaactatcaaataaggagattctatttgataatccttcacaccaatatatcctatttcttcacctattacagatatataagctgcatgataactttgtaacttttcaatattcaactctgccatagaaggaggcaaatcatcctccttatcacacgaaacaaaaataacagacagacaacacaccgctgccattagaacatactttctaaaattcataacaaaagcttattttaattaatttggggcacaaaattaactttataaactttacagaagcacgtttctatctgtttttttattctttttcgtcaatttggaagccatctatagaagaattataactcaataaaaagaaaatacatctcttctatgtacaagaagcccaaagagcaaatatttatctttgtggcagataaaaacagattattccatttgacgaacaaaatttccgttactggttataatgtagataggaggagtgccttcatacgtcatcgttacttcttcattcgaataattcaagaaaatcttgtaatttccttcatccacccgataagaggaattggaagtgtttctgatttcataagttattttattggctgtttccttatagttatcgaatcttcctcccgaataaaatttgagtacttcatattgggaacccgatgtatccaatgcacgtttccaagtagtatttacaaagaaattctcaaccgactcatcgtccttgcaagagctaagacataaaatcaaagcaaaaaagaataagatttttgttttcatagtatttatattttaggtgttcgtttataaatctgattttctattcttaaaactctctgtagaatttatagtaagccctatccgattaataaatggagcaggacaaatatagtaagctatttcaccaaagtaatatttcacatacgactgtaaacaaagcaatttacttcatgaatgaaagcaacagccttcatatttacagttatcaaagatcaaagtatatcaatttgctacaaggttcacaaggtttaccaaatatagcgaaaaaagtaatataaactcagaatatgccaaaatttttccttatttctgattttacttattaaaaccatctttttactttaacaaaatcgatatagccatccacaaaaaagaaaagccactggaaatgtacgtctccaatagcttttctaactttataaactcaggtagttcgaacccatgtatgttacaaactatcctttatcattatttttcaatgcttctttcttgttttgatgattgaagtaaatcacaccgaccatggctataaccgacacaagtactgacatgatcttacaagccataagcctgaaagtagtgttaatactatggcaatagacacaactgagaacaaattatagctgttttacaaccgatttttgtaaatgcttgccatcagcttctggtactgattctccagctccatgtaagcctgcaagttacgatatacgttgtcggcttccgtataataatcgataatagaaagttgtcctgcggcaacggcttctttcagcatgtccagcgtttgatgcatcagttccacgtcgtatgcctgcatggcggtagtcaactgctgcatttcgttgaactgactctgcacctgagcttctgcctgcaagcgagcattatccaactgatactgggcactgatagcttgtgcacgggctatctggtgcttcttcctattcgaaaagatcggtaaacttcctccgataaggaaaccgttgctcttttcatcgagtgaagtgttgcgacgatagcctatttccagcttcggtaaccagctctgacgacttacactgatgttcttctcggcagcacgtgcggcggcatcggcagccaatagcgtggcatcggtagtcatcacctcatcgtacaaggcgttatagtccttcagtgcttctacctgcggataatcacgtgaggtaaagtccaccggaagattgccgttcatggcgagcaactgctgtaaggcagtacgatgagccgcattgttctgcgaaacttctgtctgcacactcatccgctccatcttgattttattgacttccagtatgccggcatccccttcttccagtcgtttttcgaacaaggcaagcagttcgtcggcattctttttccgttcttccagcagaccttgctgtttgttcagcattacaagatccaagcagagattcttggcattcagcagtatactgcgacgggtggcctcgtactgacggtgaagggcctcacgctgcaactttcccgaacgactgcgtgccgcatacaaggtaggaaagtcgaatccttgtgtcacgaccagttccgaactcgacatgccggtgatacctctggtataaaacggactgtattccaccgacgggtcttccagattgttctgtgtctggacttccagctgggcagcacgggtagcctgctgctgtgcctgcaattctttattattctgttctatctgacggagcacctcgtcgatgccctgtgcctgcatgcctgccgtaaagaacaggcatgcggccaatgtgatataggtatgtttcataattactgtttattagcatctgacttcttgcagttcatcagttcgtatacgatcggaatgatgaatgcattcaggaaggtagaggtaagcagacctcccaagataacctttgccatcgggctctggatttcgttgccgggcagatcgccacgcaaggcaagcggtatcaaggccagagcagacgacaaggcggtcatcagaatcgggttcagacggtcgagtgaaccgtggataatgctttcacgtactcccatgccctgctcgtcgcgcaaggtattgtaatggctgatcagcagcataccgttacgggtagcgataccgaacagcgaaataaatccgatgatagctggaatgctgacttcacccgtggtaaacagcagggcgaagacaccacctatcagggcaagcggcaggttcaagagaatcacgccactctgcgaggcgttgcggaactgtacatacagcaacaggaagatgaccacgatactcatcagcgaagtaagcagcaaggtacggctggcggcctgctcgctttcaaactgtccgccgtattcgatgtgatagccttcgggtagctgtatcttttcgttcacccgtgcctgaatatcgtttaccacactgcgcaggtcgcgtccgctggtattggccgaaatgacaatcttacgcttaacgttctcacggttgatggtattcggtcccatggacgattccacacgtgctacatagctcagcggtatcttgcgtccctgggcatcgtctatcatcaggtctttgatgtgttccatcgagccacggttgtcttctgccgcacgcaccacgaggttgaacgattttccattctcgtatacctgagaaaccacttcacccgccatgttcaccgttacaaactcattgaactgtgccagtgaaatgccatacttggcaagcatctcgcggcgaggcacaatcttcagttccggacgctctacctgctgctccacgttcaggtcggcaataccttccacatcccgtatcgcatcctttatctggttacccagagagaacatcttgttcagatcgtcgccgaagagcttaatggcgatgcttgcctgcgtaccactcagcatggcatcgatacggtgactgatgggttgcccgatttcgatgttggctccggtcagtaccgacaacttacggcgtacgtcttccagcacttccttgtgtgaacggccatccagttcgaacggagcttctatctcggatacgtttacgcccagtgcatgttcgtcgagttcggcacgtcccgtcttgcgcgctacggtctttatctcgggtatagtaagcagcagttcttctgcctgacgaccgattttatcggattcctccagcgagatgccgggcagcgaactgatgttgatggtaaacgaaccttcgttgaaggacggcaagaagctgtgtcccaaagtaaagaacgctcccagtgcaaccacaaacaaagcgatggtacttcctaacaccgttttcttatgtcctaaggcccaaagcagtccgcgttcgtaatgctttttcagccatacggcaatgaaggcttctttcggtagtccgtctttcttgaaatctcctcccagcagatagctgcacagtacaggagtgagtgtcagagcgacaatggtcgaagcaaacagtgacacgatgaatgcgatacccagcggaaccaacattcggccttccataccgctcaggaagaacaaaggaacgaaacttacgatgataatcagcgtagagttgaggataggcatacgtacctcgcgtgaagcatgaaataccacatccagcacgggcttgcgctcgccgacggggagcatgcggttctcacgcagatgcttccatacgttctccacatcgacaatggcatcgtctaccagtgaaccgatggcaatggccatacctcccaagctcatagtgttgatgctgagtcccatatagtgcaataccagaattgcgatgaccagcgacagcggaagggttaccagtgaaatgatggtggttcgtgtattggcaaggaacaagaagagtacgatgaccacgaagatggctccctcgtaaagagattcctgtacgttgccgatagagctttcgatgaaacgcgactgacggaagatgtcggtagaaacctttacatcggcaggaagattcttctgtaagtccttcaacgctgcctccagtttctcggtcagttcgatggttcccgtattgggctgtttggtgacggtgatcagcacggcgggctttcccttttccgaagccagtcccagcttgggctgctgagctcctatgcgtacgtcggctatgtcttccagcgtcaccggagcaccgtcgattgtcttgactaccgagcgtgccatctggcgaacgtcgtcggtagaaaccacgccacgcacgatgtattcgttgccgtattcataaatcactccaccgttggtattctggttcatgccacgggttactgccatcacttcacccagtgtcacaccgtagtgcttcatgcgttcgggatgcagcaatatctgatattccttgatgtcacctcctaatacggcaacctgtgccacacctccggtagacagcaggcgcggacggatggtccagtcggcaagggtacgcaagtcgagcatggaagtgctgtcggctgtcagtcccactatcagtagttcccccaaaatagacgactgagggccgagggtgggattgcctacgttgtcaggaagcgattctcccacggctgccagcttctcggaaacaatctgacgcgccaggtaaatgtcggtaccccagtcgaactctacccataccacagagaaacccgttgtagacgatgaacgtacacggcgtactcccgtggcaccgtttacggctgtttcaatcgggaaggtaactaactgctccacctcctcggcagccatgcctcccgcttctgtcatcaccaccacggtaggagcgttcagatcgggaaacacatccacttcggtatgaaacgccgtataggtacctcctatcagcagcaagaccgaagcgaccagaaccagcaagcggttctgcaatgaaaaatgtatgattttattcagcataatactctaataaatgatatccgtatctgataaatactacccgcatatcaatggttgtgggtgtgtgcaggaatcgcattgctggcagcagccagtttcacgtgcatggctccagcggtcacgactttctcgcctcccttcaggcctgaaaggatttctacacgggtaccgtcgttcatgccgagtttcacttcctgcttcttgtatccttcggcatctacctgaaggtatacgaagttcagtccctgttcttcggttatagccgaaacaggcagactgatgactccctgccgttctcccgacaagagatagacttcgacgaaagagcctgccagcatgtcgccgcggttgtcaaattcgaaagttacgggaatatagaacgatgcgtcgcccgaggatttaccgtacgagagcagacggcctttcaggtcgtccagccggtagaccttgttatcataaggagtggtgaaattggccgaaacaatcgatttcagttcggcataataacgctcggacacctcagccttcagttgcaggcggcgtgtctgagtgacggtcagcaaaggctgtcccacggtcacgtaatcgccttcctttaccagacacgacttgacgtatcctcctatcggcgacttgaccgatactccctttccgtccttgctgggcgaaagggcttcgtaagcgatacgggcattttcataattctctttcagcaggctgaaatctttctgcgaaacaatctgcttgtccaccagcttggcagcacgttcgtattcacgcttggccgtttcataggcgatacgggcacgcttcacggcatctccttcctgaatatgctgcgaagaaaccgtcagcagtgctgcaccggcacccacctgcattccctcggtcagcggacgggtaaaggtcactacccccgacacacttgccacaacggtagcctcatctccctgagccgccagaatctgtccgctggtggcaatcacactccggaacgtaccgggctgtacctcctctacctttactccggcagcctttgccttttccggagtcaatataatttcatcggaatgagctgcatgtgcttccttcgcttcagcctccgcttcatgatcatggtcatgttcttcatgacctccacaagctcccagcatacacgctgccagagctcccatccatatataacgcttcatttgaatgtaaatataattaatgtattaaacacaacgatttagctatccgcaccacaaaggtacggatgttctgctgcaaccgggttgcagtttttcatacacaaattacagaagcggggggagcgcgcagtcctgctacctgaacaaaataatgtgcatgcagactctctacatacagcgcccagtcggcatcagcctcatcagccggtagagccagtacatgcagtacaggaattaacggataaagtatggaataaaaagaataatcgggagcaatgtcggacaaatgctggtcgggcgtaccgcactgaaaatgagttacacaagtactaccgcacgaatggcggtcggcatcatcgctatgatgcatgtttccactgcatgtttctgtgctaccgtacgaaaccagatcggacgacaagcagaatatttccgaatgatgatggtgcggaagtacctgggcaaccagcatcagcatgcagattaccagcaaaatatacgatttaaacttccgcttcatcatccgtttgttatttaatgattctaaaatcaggcttcttcatcaccattgtcttcggctatgggagtcgtgaccagtaccttgtcgatacgtgccccatccatgtcgaccacctcgaaggtaaacccgttccagtcgagtgtttcaccgctggtagggatatgctgcaattctttcaggatcaatcctcccaaggtatgatattccgaagtttcgaacaagtcgctacgcttgaagtagcacaagaagtcgtacagcgagcactgtccgtctaccagccagccttccttgttcacccgcttgatgatatcgggttcctcacccggatcgtctacgttgcctaccagaccttccagaatatcgcgcagggtaatgatacccgtacatacaccgaactcgtcacaaaccagtccgcgactgattttctgaatcttcatctgttcaagtaccttatacacattcatgctctcgtggaagtaggccggctcatgaatcagcgaagccagcttgaagtcgggtttcgacaagtgtaccaccagatccttcaggttgacgatacccttcacatgatccaggtcaccgtcggctatcggataaaactcaaacaagttttcgttcaccaccgctcttacctcgtcggcagtcatgtccatatccagccatacaatgtcacttttgtgcgtcatgatggagctcaccttcagatcgcccagcaggaatacacgctgcatgatgtcattctctaccggctgaacctctccttcttcggttccctcctcaatgatagacttgatttcctcctcggtcaccttgttgtcagcttccttgatattcagcagattgaaaataagttccgtactcttggaaagcaaccatacgaacggcaaggcgatagtagcaagtaccctcataggacgagccatcaccttggcagccttctcggccacgctcataccgatacgtttcggtaccagttctccgaaaataatcgtcaggtaagttactatcacaacgatgacaccctgagccagtgcagcggcgtaagtagtagaaacgccccacgaaatcatggtttcggtcaggtcggaagcaatccgattgcccgaatagataccggtcaaaataccaatcagggtaattccgatttgtacagtagaaagaaagcgatcggggtcattagccagtttcaaagcgacctttgcagacttgctacccttcttcgcatcagaagaaagccgagatttacgagctgatattaatgctacctcggacatagcgaagataccgttaagtactatcaacccgataattatgattatctcatccatataaaaaaactgtgtttgcctgacaaatataacggaatgttccatgactataaaagataatttatacaattaaacagttttaacaaaaaaaccttatcagaggttataatccgtacattttgctctcaaacagaatacatttctgtaaatactgctagctttttccaccagtttacgatgattgagccttccgatttttgcctgccgctacatttctaagcgtaaaatccctatctttggcgcaaaaatcgaaaaaatggatacagaatacttaaattactttgaagaaaaattgcagcaggagctgctgcgcctgtgcaccaattacggcgtactgggcggcactctgctagcaaccgacgatattgatgcccgctggaacgacctggcacccgaatacatggccgatgccgtacagcagatacgcgactatcccatcgtatcggtggcgtgggctgcttatctgggactggctgttgccgctgaatgggatgacgactggggcagctatgcacaggctccttaccactcgtactacggcgaacaggcgttcgacgacatggatgaacacatcgtacacgactttctggagctgccgctcgacggcgaagaggcggaacaactggccaacatcatccgccgctgcggacaaactaccgtaggcatgatacgccacgaacagatcgagccgcaaagcccgctggctttccacatctttgcccgtgcctgccgtgcgatgttccgcatcggtgccgccatcgagctgaaacgtctgggatacaagttcgagaaagtagaattaggacggaatttgaacgagttgccctcttaaattcttccttttttcgtatctttgcgcatcactagatctgtaaacaatcaagaaacaacatatagcatgaagcggataaaagttacatctccccgtgagataaacgccggcatccagttgccttcgtcgaaaagcatctgcaaccgcgcactgatcatcaatgcccttgccaaagggaactgtcatccgggaaacctgtccgactgtgacgatacgcgcgtcatggtacaggccttgcagcaactgcctcccatcatcgacatcatggcggcaggtacggccatgcgctttctgacggctttcctcgccgtaagcgaaggtacacacatcattaccggtacccagcgcatgcagcagcgtcccatcagcattctggtgaacgctctacgtgccttaggagccgacgtggaatataccggcaacgagggtttcccaccgctgcggattacgggacgcaagctggtgaacagcgaagtgaccttgcccggaaacgtcagttcacaatacatctctgccctgctgatgataggtccggtcctgaagaacggactgaagctcacgctgacgggagaaatcgtatcgcgtccgtacatcgaccttaccctgaaactgatgcacgacttcggtgcctgcgtaacatggacagccgaaaatcagctggaagtaaagcctcagccttaccgagcagtaccttattacgtagaaagcgactggagcgcggcttcatactggtatgagatctgcgcgctgtcggaaaaagcgactgtctgcctgccgggactgttccaagagagcccgcaaggcgactcggaagtggcacgtctgttcgagcagctgggtgtggaaaccgtttacggcaaacgagaagtaactctccgcaagacggaaaaggtgacagcccgcatggagtacgatttcgtcaaccagccggatctggcacagacgttcgtggtaacttgtgcggtgatgggtattccgttccgcttctccggcctgcaaagcctgaagatcaaggaaaccgaccgcatcgctgccctgataactgaaatgaagaaattgggatacgtcatcacggaaagtgaaggttccgccctgtcgtgggacggtacacgctgcactcccgaggccgttccctgcatcgatacttacgaagaccaccgcatggccatggcatttgcccctgcctgcatccggttgggagatttgtacatcaaccatccgcaggtcgtaaccaaatcatacccgcactactgggagaacctgatacaggcgggatttaatatcacagaggaggaataaatcatcatgtggatactgatcgtcatactggcaggagtcatcctgttcggactgattgccggttatttctataaccggaacatacaaaagaaaatagaccgtggagagctgaaggaagctcctcccgtagtaacggtggacagtgaatgctgcggacagcatcagatttgtgaaaaggaaagtctgctggctgccgtgagcaaacagatagaatattacgacgacgaggaactggaccgtttcaagggccgtccttccgacggctattcggaagaggaaattgaagagttccgcgacattctgtactccatgcaggaagtcgacgtggcaggatggagccggagcctgcaactccgcggcatcgaactgcccgacgaactgaaagacgagcttttccttatcgtaggcgaacgaagattccactaatcttcccgcccggcctgtttcactaccgaatacaactatcatggatatattagaactgttgcaatatacttttttccagcatgccctgctgggcagtctgtttgccagcatcgcctgcggcatcatcgggacgtacatcgttacccgccgactggtattcatcagcggaggcattacgcatgcttcgtttggtggtatcggcatcggactttatacgggtatctctcccctgctcacggctgctgtctttgcggtgttgtcggccttcggtgtggaatggctgagcaagcggagcgacatgcgcgaagattctgccatcgccgtgttctggacgttcggcatggctatcggaattatcttcagctttctggctccgggattcactcccgacctgtcgtcgtttctgtttggaaacatcctgaccatcacgcacagcgatattctcctgctgggtatcctgagtgtattgctgattgcattcttctcgctgttcctgcgtcccatcgtggccatcgctttcgaccgtgagttcgcacgttcgcagcacctgcccgtggctactttcgagtacctgctcatgatgttcatcgccctgaccatcgtgtcgtgcctgcgcatggtaggtatcgtgcttgccatctcgctgctcactctgccgcagatgaccgccaacctgtttaccaaccgtttcaagaacatcatctggttgtccatcggcatcggctatgtcagttgcctgggcggactgctgttctcgtacaaatatcagattccttcgggagctgccatcatctttgtttcgattctgatatacgttgtagcaaaaatcagccggcagttccgtaaacaggaataattattcccgatttttacttacttttgcagtaattcaaaaaacagatacttatggaaataaaaattacttctctcgaccatatccacgaggctgccaaagaatttatcgcagccatgggcgacaataccgtttttgctttctacggaaagatgggagccggcaagacgactttcaccaaagctatatgcgaagaactgggagtgactgatgtcatcaactcgccgacattcgccatcgtcaacgaataccgctccgatactaccggcgaactgatttatcacttcgacttttatcgtatcaagaagctggaagaggtatacgacatgggatacgaagattacttctacagcggtgccttgtgtttcatcgaatggccggaactgatagaagacctgctgccgggcaatgccgtaaaggtatacattgaggaaaacgaagacggaagccgtacggtccgcttcgacgcagaagaataatcccaagccatggctacacattacgttatacaggccatattcgtcatcgtagggctgctggctgtgctggccgccttgttcaactgggactggttctttaccgcccgcaacacgcagttcatcgttgccaatgcgggaagaacgcgtgcacgcctgttctatgccgccatcggcctgctgatgattgccacaggagtattcttcttcctgtctattcagggatatgtttgataaaaacggatatagggagaacgtcgaaggttctccctcagaatcgaccgaaaatttatacaaattttcggtttttttacaaaaacaaaaaatgtcgagaggcttttcagaaaggataaacgactattcttccaatgtataggtttcatcgtaaatatctctcaggttcctgccgtcgaataaccaatatccggtaggctgaactgcatgagtaatattcaacagctttttagttactcccgtcaaagagtaaacctccccttggaacatgacttttttctcatctacgatagttacaattaccgaagggtccttaacaaataccaacgtatctcctttcttcattcccatctcaaaataattaagaggcggacgacgagaagaatgtatcttctcggaagctgatttatcttcggttgtcaagtcattatctatttcttcagttatttcctgtgtaacgtcttccctattaaacaattccaaaatagccattgcttgctctggctttatttgaaaaaattcacgatttatattgatacgattaggagcaaaagccgtgtgtaaagctttttcaattttagcacagtcggaagcctttactttacatgcatatttacactcgaacggtactggaacacctgtaccatataattcacgcatacgagcatccaaattatctctcgttgtcatacctatctttactaatcccggcatagctggattagtaagtacatagactattccgtaatttgcttgtttcgtgttcatcacagacatttatgcttatcacttcgaatttatcaatattgatacgatatattccttattgttgtttgtacaaaagaaccatttatcattgcaaatatattaattatccatcacaaatttctttccaacaattcattatccctcccaaaacaaaaaaattgacctatattgctttcggattttcgtacaacaatctcactcaactcactaatacactggggatttcttccccatatctccccaatattccccaactattccaattgtctttctttagagattataaagataactcactctgttacaagggttaaagtttactcttccattattccttacatccgggtacgaactttgtatatatctttctataatcttatttccttttgttttaacctatacaggaaacctatctgaaaaatattttaactaaaataaatcctaatcgaatgaaaaagactattctaagtgtattttctttcttgctgttgttaggcagcggacttccaacatacgctgctcaagggcttcgtcccgacgggaacagtccggaaatggatgacaacttgaaaaagcagaaaacggtacaaggtattgtcacagatacaaacggagaacctatcatcggggtaacgattatcgaaaaaggtacgaccaacggtacgacttccgacatggatggaaaattctcactgacggtaaatgccaatgctgttcttactttttcgtatctgagttatgtgcaacaagaaataccggtcacgggacagaagtttctgaaggtcaccatgcgtgaggacagtgaaacgctggaggaagtggtggtaatcggatatggtacggccaaacggaataacctaacgggggctgtcggatcggtaaacagtgaacagtttaagatgcagcctgtcaagaaggcttccgaaattctgcaaggtcgtatggcgggtgtgcaagcttcgtcgtatacaggcggacagctgggacaggatgccaatatccgtgtgagaggagtgtcgtccatcaacttcggaaacgatccgctctgggtggtcgacggagtgatcggaggaagcgtgagcaatcctgccgacattgcttccatcgaggtactgaaggacgcttcatcgacagccatctacggttcacgaggtgccaacggagtcattttagttaccaccaagcacggcacgaccggtaaggcacgtgtggaagtgagcagtgaaataggcatctcgaatatgccgaaacggttcgacctgatgaatcccttcgaatatgcgcaggcgttgcagaatatgaccgatacccgtttttccgaagaggatatggcggctttccaaaatggtacacgcggtgtagattatcaggaccttatgctgcagacgggtatttcgcaggattataagctgagcatttcgggaggaagtaaaaagacgaaatacatggtatctggactattcctcaatcagtcgggtatcaccgccgaatcgcatttacgccgtttcgggttccgcacgaacctcgattcacaggtcactccctggctgaacatcgtgagcaacatagaggcttctactgaatcgtcgcacaacacgggtgccaacttatttgtcatggcgaactattctccagccatgaacctgacggatgccgacggagtgtaccagaaggatccatactgttccatctctgccaatccgtacggagcactcatggcaaacgattccgacggagagaattacaacgtaaagggaatggtggatttccgtttcaatattctggacggactgacattctcggctcagggagcgttcaacttgctgaatgcgtcgagttactccttctcgtcgagcaaacgtgaacccagtgccatcagcagcatgggcaacagcatgagtcgtaccgtaacgtaccagcaaaccaacaacctgacgtaccagaagagtttcggcgaccataatctgacggcaacgggtgtgttcgaaatttattcgaaggaatacaagaatgtgggagtgagcggacaagacctgttgtcggaaaaaacagggtactggaacatcaaggctacgcagtcgggactgagcggtacaaccaactatactaaggagcagatggtttcggctttcgggcgtataatgtacaactacaagaatcgctattacctgaccggaacgatacgtgccgacggctcgtcgaagttcatgaatcacaaatggggatatttcccctctgcagcggctgcatggaacctcacggaagaaggttttatgaaggatcagaatctgttccagctgctcaagctgagagccagcttcggtgtgaccggaaaccaggcaatcaatgcgtacggtaccttgggactgatgacgcttgccaattattcgtatggcacgggaagtctttatccgggctattggcagaacacgttctcggcacccgacctgacatgggaaaagacgtactcgtatgatgcgggtatcgatatcagcatgctgaaccaccgcctgaatctgacagtcgactggtatagaaagaataccaaagacttactatttgccaagactattccgtatttcaacggaggaggttcgtactggagcaacgtaggaaagatgtacagcaccggatgggaatttacgctggaggccgacctgatacgcaagctgaactttgaatggtcgactacctttacggcatcttgcctgcatacggaagttaccgacttggacggtgaggaacagttgattccggatgccagccggggcggtctgatggaaggaagcgtgttcattatgaaggaaggattgcctatcagcaatttccacctgttcaaatggctggggcttgacgaaaacggtgccaacctataccagaccgccgacggaggtacaacgacttctccagtggatgccgaccgtatcattaccggaaatccgattccgaagtggaacttgggatggaacaatacattccgctacaaaaactgggaactgaacgtcttcttcagaggaagtaccggcttccagcgcctcaacatcactcgctttgctaccagcaccatggtgcccgaaagccgtttcatcacctcacgcgaaggatacgaaaaaagctgggatatcgtggctaacaaagcggatgccgaatttgccagcagcaagaatgcacagaaccgttctacccctcgctctacgcaatggctggaagatgccgactttgtccgtttgcagaacctcagcctgatgtatacgttgccgaaaaagacgacccgctttgccgacatcacactgggcgtgagcgcacagaatctgttcacgctgacgaaatacaagggacttgatccggaatcgtctactacttcgtcgacctctaccggtgcggtgtccgacaaggaactgggactggattacggcagttatccttcggcacgcacattcacatttaccgttaaattaggattctaaaatcagactacgcaattatgaaagcacttacatacaaaatagccgttctctgcctctcggcgctgactacggtttcttgcagcgacttcctgcaggaagatcccaaaggacagatgacgaatttggaatcgtttaccgagaaatcggatctggaaggttccatccatgcactttattatcaggtaaagatggcgagcggatatgtcggcatctatgccccggtactgatgggcgacgatatgaccagcattatctcaaaaagtaattttactgactgggaccagtttgtttcaaacgacggcaactcgatgatgacgagcggcgtgggatgctggagctgcatgtggaacgtggtaaaggctgccaattatatcatcaacggggtagcaaagacaccgggagctactgccgatgatatcaactttgccattgccgaggcgcgtttctggagagcatacgcttacttctggatggtacgctgctggggacctctccccattatcgaaagtttccagctcaacgtagatgctacagcacgttcggaagagcaggtatacgatttcttagtgaaggatctgaaatttgcggaaacgtatctgccgacggaatatacgaccgaaccgtggaacatcaacggaatgaataccatcgctacccgggcagctgcacaggcggcactagcacaggtgtatctcaccatggcaggctggccgctaaacaagggtacggaatattataagctggcagccgacaaagccaaggaagtgatcgatcaggtggaaaacggcacgtacaagtaccaactgttcgacgagttctggaaagtatattcgcgccagtataacaagaccaatgcggaaattatcctgccagtttatttcaccaaagatttcggtgtgggcgatgcttcgcaggctgcacgcggactggcggagcttccggaagaaaccggcggattcagcgacatgcgtgcggagatcaagttctggaaagaatttccggcaggaccgcgcaagaaggctatcttcggcgatgtatattatcacaatcaggacaagaaagtggtgccttggttctacgacaacgtaaccaactgcaacaatccgtactatgtgatgtttgcctttgccaacaacgaggtggaatacgaccagaccaagagttacaacgaacaggccgacggctggagcgaacagacggctgcctttatccgtctgccggaagtatatctctggtatgccgaggcagtaggacgttcgggcagtggcgacaagacaaaagccatcgaactgctgaacgaggtaagacgccgtgccgacggaaaatggaacgacccatcgtacaattattatccgtctacgctgtcgaacgaggaactggcggaagcagcatacaacgaacacggatgggagattgccggatactataaaagcatgactacccgctaccacgacgaacggcgcatgaaccgtctgaaagaccattttgcctaccggctggtaaatccggaaatagaggttacggaacaatggctgaaagaaaaccccgacaaggcagacatggtaagcggtccggtatacatgaaagaacgtgtcaccatgaccggctcgtgggacgacagcaagatgtatgcgccttatccttcgatagatacctctctctatccttccctgaagcgataacaacatcctaagcataaaaaaatccggtgacgttttttaaaaacatcaccggatttttcatttattacgccgacaaatcaatcgacttgtcccaatgaatttccgtattccatttcgccctgaaccacgaagaacacatcgtcgggttcgaaaggtcccatgccgtctttcttggactctttgactatgtagtttacaatttcatcctggtcgatgttgatgtaaccctcgtcatcaggttgagcgtccagacaaccactggtggtataatagtctactatcaagtcgagaatgtaatacagatcatcgtccgtaaacttctctttcagttcctgaggcaaatagttctttataaactcgatggtcttttcatcgtcctcatcttccaacaagaaatcatcatccatactcatagtcgtagtgcgtttgttaaatgattatttcaataaagcttcaactttttccttcaaggcagcttttgtagtagcacctacctgcttgtcgactactttaccatccttgatgaaaagtacggtaggaatgttacgtacgccaaactgtgcaggaagatctgcgttgtcgtctacatcgcacttgccgatgttcactttatctttatattcttctgccagttcttcaatataaggagcaatctgcttgcaaggtccgcaccaagttgcccagaaatccaaaactaccggtttaccttcagctacaatagcttcgtaattgtcatctttaatgttcaatgccataattctagttatttagttatttaattatctacgcaaatatatactaatttattttatagtccaacaatggctggctttttaaataatttataatgtcttttctgacggatattttcagcgtacgcgacatgaggttgacgtgcatctgtccgtcctcgtcgcggatatagaagaacagctcggcattgccgggattttctttcaccagcgaactgaattccataatcatctcgtcgttgatggcagagagcggtgccgtcaccgtaagtttctctatcaagcggtctttcacctcgggcaggagttcgatgttgttgatctttatctcccactcgtcctgcttccactggcgggggtgacacttgccgtgcatgaacaagaacattccttcggcgaaaaagttcttcttttccacccattcattgccaaaaaatgcaaattcggccgttcccgaatagtcttctacctttgccacgccgaaaggcttgccggtcttggtatatccctcacgcacgccggtaacgatacctcccagtgtcaggtcgtggttatgcagcggagtcaggtcggaaagctgtgccatgtgtgtggtacagacattttccagtatcaccgagaactcatccagcggatgggcggaaagatagatacctaccagttcacgttccttattcaggcgttccagatcgctccatgccggtgcacggacaatttcgggggtggcaatctccacctcatgctcgccgccgaacaaggaattggcagcagccgccttgtccatctgatacttgtttccgtagcgtaccagcacttcgacaaaggtttcgtccttggcattcttcacgaagaaatcctcgcggtggatgttcgggaagctgtcgaaagcaccggccaaagccaggttttcgatgttcttacggttgcatgccgaaaggttcacacgctgcacaaagtcgaatatattcttgaaaggtccgttcttctcccgttctgtcagaatgctttgtaccgccgcctcaccgactcccttgatggctcccagtccgaaacgaatatctccgtgacggttgacagagaacttcaggctactttcgttgacatcaggtcccagaacgttgacacccgtcgccttgctttcgtccatcagcttggtgatttcggtgatgttcgaaatgttacggctcatggtagccgccatgtactccgacggatagttggccttcaggtaagccgtctgataggcaacccacgagtagcaggtagcgtgcgacttgttgaaggcgtaggaagcaaacttttcccagtcggcccagatcttttccagaatcttcgggtcgtgaccattcttctttcctccctcgatgaacttaggtttcatgtgatccagcttgtcgcgcagcttcttacccatcgccttacgcaaggcatccgattcgcctcgggtaaaatcggcaagcagacgcgacagcaacatcacctgctcctgatacaccgtaataccgtatgtatctttcaggtatttctccatgaccggaatatcatactcgataggcttgcgtccctgcttacggtcgatgaagtcggggatataatccatcggccccggacgataaagggcgttcatggcaatcaggtcttcgaacgtactaggctgaagttcgcgcaggtacttctgcatacccgccgattcgaactggaacgtaccgatggtccgaccgtcgctatacaacttataggtagccggatcgtcaatcggaatttcatcgatattcagaatgatgcctttactctgcttgatattctcgagtgcctccttgatgatggaaagcgtcttcagtccgaggaagtccatcttgatcagtcccgtatcttcgatgaccgaaccttcgtattgcgttaccagcatcttttcgccggtttccttatcgtcggccgtgctgaccggtacccagtcggtgatatcgtcacggcagataatggtaccacaggcatgcacacccgtattgcggacgttgccctccagcatcttggcatacttgatggtatcgcgaagcaccggatcggacgacacttcggccgcctgcaactcgggcacataagcgatagcattcggaagattcagtttcttatcgggaatcttgtcagggataagcttgcacaagcggtcggactccgagagcggcagtttctgcacacgcgccacatccttgatggcaagcttggtcgccatcgtaccgtaggtaatgatgtgcgccactttttcctgaccgtacttttcggtcacccaattcaacacacgtcctcgtccgtcatcatcgaagtcgacatcgatatccggcaaagagatacggtcggggttcaggaaacgctcgaacagcaagtcgtatttgatagggtcaatctgcgtaatacccagacagtaggccactgccgaaccggcagccgaaccacgtcccggtcctacagatacatcgagcagattgcgggcagccgaaataaagtcctgcacaatcaagaagtatcccgggaaacccatggtcttcatgatatgcaactcgaacttgatacgctccctcacctcatcggtcaggtgttcgccataacgacggcgcgctccgtcgtatgccagtttcgccagataatcggcctccagcttgatacggtacagtttttcgtaacctcccagacgttcgattttcgcctttgccgccgcctcgtccatgacgacgttgccgttttcatcctgcgtaaactcatcgaacaaatctttctcggtgaatttcttgcgatattcctcctcggtaccgaaatcctcgggaatggcaaaggtcggcatgatcggtgcatggtcgatggaatagaactccacctgatcgcagatgtcgcaggtattggtcagcgcttcgggcacatcggcaaaaatttcgttcatctcctcacgcgtcttcatccattcctgcttggtatagagcatacggttcggatcgtccaagtcctttccggtactcagacagatcagacggtcgtgcgcttcggcattctcttcgtccacaaagtgcacatcgttcgtgcagaccagcttgatgttgtattttttcgaatactccatcagcttcttgttgaccacttcctgcaatttataagtttcgtggtttgcccgcggcacggtagccttgtggcgctgaagttccagatagaaatcgtcgccaaacaaattcttgtaccactgaatggcctcttccgcctcggcaaactgtcctgccgtaatgcggcgcggaatctctccacccagacaagccgagcagacaatcagtccttcgtgatatttttccagttccacgcggtcggtacgcggacgcatataaaatccttcggtccatgccttcgataccagcttgatcaggttatgataacctttcaggttcttggcaagcaccaccaggtgataaccgctctggtctgcctttccctctttattcgagaggcgacggcgtgccacatacatttcacaaccgataatcggcttgaacagtttcttcttggcagcttccagttgctcgcggcattccgccagctctgcttccggattttccgattcggcttttccgctttccagcgcggcaattttcttctttaaatcctttatctcgccatttgttcccccgttcttcttgttcacatagttgaagaactcctttatgccgaacatgtctccatggtcggttacggcaatgcctcgcatcccgttggctatcgccttgtctaccaaacggggaatagaagcctggccatccagaatagaatattgggtgtggacgtgcaaatgaacaaaatcgtgcatatttacattattaaaaacagagttcaaagataccgaggtttcggagaacaaacaaaaacaaacgaataaagttattgccgatgaatactttttagcaaaaaaatatagaaagagtcaattctaacggtactttatttggcaggtttttaaaataaatatatttttgcacgataaaatgtaactttgttatgaccggattaaacaaaattaaaaagataaagaaaataagactacaccgggaaggtactcacattcttataaccagcgcaattttattactcattattaatactgcattatactggggaatagagtgcaaaatacctttctacattatagctatcgccagcatcattctctatctgctgatggtgaatttcttccgttgtccgatccgtctcttcggtggtgatacagaaaagattgttgttgctccggccgacggacgtgttgtcgtcatcgaggaagtggatgagcatgaatatttccacgaccgccgactgatgatttccatttttatggatattacgaacgttcatgccaactggtatccggtagatggcgtgattcgtcacgtagatcatcacaacggacgtttcatgaaagcgtggctgcctaaagcaagtacggaaaacgaacgttcaatggttgtcatcgatactccggaaggacatacggtcatggcacgtcagattgccggtgctgtagcacgccgcatcgtaacctatgcagaaaaaggagaagactgttacatagacgaacacatgggattcatcaaatttggttcgcgtgtggatgtatacttgcctttaggtacggaagtttgtgtaaaaatgggacagaaaacgacgggtaaccagactgtcatcgcaaaattaatgtaatgaatgtaaggaggaacagagatatggctaatgcaatcgtccgtaatattccaaatacattgaccagctgtaacctgttttcgggatgtattgcagcttatatggcttttcagggaaagtatgaatgggccttgacgttcatcgttatcggtgccgtattcgactttttcgatggcatgacggctcgtttgcttcgcgtttcctcccctatcggcaaagaacttgactcactggcagatgatattaccttcggactggctccggctgctgtggctttttcgttgttcaaggaggtgcattatccggatttcctgatgccgctgtccggcttgatgccttacacggcttttctgatagctgtattctcgggactgcgactggcaaagttcaacatcgacgaacgacagaccagttctttcatcgggatgcctacccctgccaatgctctgttctggggttctctggctgtaggcggacatgcttttctggtatccgacagctttaatgcaatctacctgttcatactggttcttgtcatgtcactgttgctggttgccgaacttccgatgttttctttaaagttcaaggatttatcgtgggaacataacaaagtaagctacatcttcctgattgtcagcattccgctgctgataatcttccagttgagcggcattgcggcactcatcgtgtggtacatccttctctcgctggtgactcgtaaaaaatcataaaacaataatcgtggcacggttgttgttctttaactcttaaaaacaataactatgtttcatattctaggatttatatttttcttcgttctgattatctttgtcatcggactggccatactttccaaaattattcgtagcgtatttggcctgggacgccgcatgacaggaagttcctcgtcacaaagtcattcgcaaaaccagcgcaattcttcttccagttatcgttcttccggcaacgacgaatcacagcagcctgcccggaatgcttcaggccggaaaaagattttcgacagcgatgaaggtgaatatgttgactttgaggaagtaaaagaatcttaatcatccaatcgtcacaattgacacacaaaaggttacttcaaatttgaaaaatgaggatgtgactcggtaacctaaagctataaatataagaaatttcctactttggcttatttgtttaatgagaagaccaaagcagaagatttttattttcaaatccgcaacaatacattgatcaacaagtgatagacaaattctccagtgaacttattcaataagaacaatgctgataatcatttataatgtttatttgacactaaaacaaaatttctactatcgccattctaccttgagggaccgtttaatcatatcgaataaaacaaaaaaataatgtttatccagcacgaatacaaggtttctacggttttgcagttctaccttaaaacacccatctgatcatatcggattagacataaaaatttcccgcttacagatcatatctctatgagataattcctttaagcgggaaatcttgtatacgaaaactgaacgaaacacttactcttcgtctaccaaatcctgtatcggcatctgacgcttgatagcctcacggaaggaaatgatagtttccgaacgcgacaatcctaatggttgcaacttatcgtgaataacgttcagcaaatgatgattattctttgcgtaaatcttgataaacatgtcatactgtccggttgtataatgacattccactacttcaggaatacttttcaaggcctctgtcaccgaatcaaactgctcgggatcccgcaggtataacccgatataagcacaagtttcataaccgatcttttcgggatctattataaattccgatcctttcaatattcccaagtttgtcaacttctgaatacgctgatgaatcgcagcacctgatacattgcaggcacgtgccacctccagaaagggaatacgggcattgtcggcaatcaagcgcaaaatctgttcgtctaaactgtctaattgatgatgtcccattgatgaatttttatttttgtacaaatatagtatatttattccatacgcgagataacaattataacttttatcattgttttagcactaaattggcagatagttctatctttgtaaaaaataaatcttttgttttttatgaaaaaaaatatattggcagcattgctcctgtcggccttcgtacaggctggaggttatgcacagaacttcaacgatttcttcgtcgacaagacactgagaatcgattacttattcaacggaaacgcacagaaacaggaaatcagcctcgatgaactggtttcgcttcccggatgggcaggaagaagaaatttcctgagtgaacttcccctggaagggaacggcgaaataaccatgagggataaagctacgggagaagtaatctaccgtacctcgttctccagcctgtttcaggagtggatcggtgaggaagaggcaaaacacgtaacaagaggctttgaaaatacgttcctgttgccttatcccaagcacacggctacagtaaccatcgaactgaaaaatgcgtatcgtaagccttgtgcttcgcttacacatgaaatcaatccagaggacatcctgatccaccagcgtggtatgacacagattactcctcatcgttacctgataaagaatggtacttccgacaaatgtatcgacctggctatcatggcagaaggatatacggaagaggagatggatctgttctacaaggatgcacaaacggcatgcgatgcgatcttctcgcacgaaccgttcaaaagtctgaaagatcgtttcaatgtagtggctgtagcaactccatcgcacgacagcggggtaagtattccacgaaaaggagaatggaaaaatacggctgtcagctcacatttcgacacgttttattctgatcgttacctgacaacccgtagcgtaaaggttatgcacaactggctggcaggtataccctacgaacatattattatcttagccaataccgatacgtatggaggaggaggcatttacaattcttacctgctcacaacagcccaccacccgatgttcaagcctgtagttgtacacgaattcggacacagtttcggtggtctggccgacgaatatgcatacgatacagctcccagtccgttatatccgtatacgatagaaccatgggaaccgaatatcacgactttggttcatttcgaaaataaatggaaggatatggtaccggcaggtacacctgtaccgacaccagcagaaactgattcgactactatttataccaaagtaggagtttatgaaggtggagggtatacgctgaaaggcatttaccggcctaccaccgaatgtagaatgaaaatcaatgaagctccccgtttctgtccggtgtgcgagcgttcgcttgagaagacaattcatttctataccgactaaatcgattaacccatgttgacatttagcaaaattcagaccagtcatcccctctacagtttcgtagagggactcctgcatcaggcgtttcccgtagacgaacgcagagatgacgatgcacagcgatataacaccgatcatagtccagccttcaactgttatctgattacagacgaggaggaagaaaacaaaacagctattggcttaattaccgtatgggaactgaatggattccgctatgtagaacacttggcaacttcccctgccatacgcaataaggggtatggcaaacgtatcatggaagcactgcaaaaagagtttccgggaatcatcattctggaagtggaaagaccggaagatgagatgagtacccgacgaatagcgttctaccagcgatgtggctttaccctatgtaatcaggactacttacagcctccttatcgaaaaggtgggaaaagccttcctctctacctgatgtacgcgggtacagatagcattgacgaacaatatccggaaataagggatgaaatttaccgaaaggtttatgacgtaaaataacagtaagaagccctggctaaatatgtgacgcatctttaaaacggtcatttaccagaaagggaaatacagagagatgataaattaaacccaatactacagtatcgaaagaatcgtccttttatcagaaacttataaaaacaagagaggctactccgtttggagtagcctttttaagctttataattgaactattacttacgctgtgtagcagaatagttaatcttcaaagcataagcctgacgaagagcctgttttacttctgtaacgatacccatcttagtctttgcatcgactttcaatgatacagtcataaacggcttatcagcttctttcatgttttcacgttcctgataaatgtaatcctgaacttctgaagcttcagcgaatttatcattcaactgaatacggtcggtagtacccatctttttctgatattcgggcaacggcttaccgatgtagatgaaagaaaccaaagatttcttttcaagcttttccaattctgttgcagcaggaaccttaaattgtactttcagcgtaacttcacgcatggttgttacaatcatgaagaagaacaacatggtaaagataaggtcaggcaaagaagaggtgttcaattccggcatctcgcgcttaccactcttattaaattttcccatgattagtttcctccatattttttaggttctgcttcagaaatcttctgtggataatagtccatgatagcatccttctgctcttcagaacattcagagaactccttaccaaactgagctttagccagttcattacgtaattcgttgtaagcagctaccaattcgttctgaacctgaagataagcatcatagctagtaccaacgtcgttctgtacagaaattacatgtttttcagtaatcattacatcaccaaagaaaggaagggtcttcggatgtttttccggcaagtttggatcatccttcgggtttgcaatgaattctttagccttttctcttaattgcttaatatcagaccattctccaccaaccatcaactggtcgtctttgttcaaacgaatctggagaacgtttctttcctttacaataatatcatctttctgatctttgttttcgggtggaggcggcaaacgtctcgctaaaccacggtcagtatccattgatgttgtaataaggaagaagataagcaacatgaaggcgatatctgccgttgaacttgcattaattcccggcacttttctattcctttttgccatttttacttacttcgtttttaatttattaaacttcaatgtagatattatctcttaaagataccagataagttaaccaatgcaccgattgcagcaatagcaaacaatacataagttgagtaaaggaacatatcagttactttcaacatagtagtatctgaatattcagtaccgccacccaaaactacagtttcagaagaaccaagattataagtaacgatcaacagaactaccaacagaatcaatcccaagagagatttgatagcacctttcggattatctttcaaagcaccaccaaactgagcgatagcacaaataagtgtagctattacagtcaccgcaaacattccgtacatcaagtacatcaaggccggtgtattggcaggttcaaccaaacctgctgcatttgtttcgttgtatcctactccatagaacaaagccagcacaactataatcagagcgatgcagacatagaatatgtagtaagaaactttatatgataatttagccattgttcaataattattttttgtatttcaagttgtatttcatgattgtatcaagcaaagtgatagaagaatcttccatctggcttgtgatagcttcaatcttagaaagaatgtagttatagaaaatctgaagaatcaatgctacaatcaaaccgaagatagtagtgatcaacgcaactttcataccagcggcaacaactgtcggagaaatatcaccagcacgctggatattatcgaacgccataaccataccaattacagtacccaagaatcccaaagacggagccattgcgatgaacagtgtgatccaagagcatcctttttcaaggtaaccagcctgaacaccaccgtaagaaacaacagaacgttcaacaacatccaaaccttcgtcgattcttaacaaaccctgatagcagatagaagcaacaggaccacgagtgttacggcaaacagtcttagcaccttctacatcacctttttccaaagctgcttcaactttagccatcaatttcttaacgtcaacttcagccaagctcaagtaaatgatacgttcgatacagaaagccaaaccaagtaccaatgcgatagcaaccaatgacatgaagccagcgtcaccttcgataaacttagttttcaactctttgtgtatacctccttcttcaactgtagcaggagcggcagcttcatctgttgtttcagcaggtgcaacctgttctgtttgttctggagctgctgtagctgtagaatcctgagccatagctgtctgagtcattccaaatgagaggactcccatcactgcaagaattgcaaataactttttcattgtgtgtctaatttttaagattaaataattaatagttattataaattgtttttttaattgtttcttttacctccttgcggagagaacgggattcgaacccgtgatacgcttttgacgtatacacgctttccaggcgtgcctcttcaaccactcgagcacctctccttcaaaacctcgcttggaagcctttttcttaaatcgaacgcaaattacaaataaaaatgcgaatgacaagcgatttctgctacaaatgtatttttttttttcgtcttacataacattcgttccccaaaagtttatttatagccctaaaattaataaactttaaaaactatttctggcattttcaaaaactttcaacgcgttttctgaggttatacggcctatttcggccatcgaaacgccatatacttcggaaagtttctcggctatttttaccagataggcactctcattacgtttgcctctataaggtacaggagccaggtaaggggaatctgtttccaatacgatacggctcaaaggtacagatttcagaacttctggcaaaatacttttcttaaaagttacgacaccatttattcctaacataaatctggaatattccatcagtctgccggcatcttcttccgtaccggtgaaactgtgaaagatgcccgaaagtgaagtattccgatagggttccagcacctcgagcaactcgggataagcttcacggcagtggataatcaacggcaaattgaattccaaagcccattttacctgaatatccagtacttccatctgttccttccggaatgtcttgtcccaatacaaatccattcctacttctccgatgccatagaaagtctgttccgaacgaagccacttttcaacaacggccagacgttctttccagttttcgtcgaccgacgtaggatgaaacccgatcatcggatagcatccgtcgtgcgaattacacagtgccagcatagcctccaccgaagtatcatcgatgttcggcataaacagccgcgttactccagcttccttggcacgaataatggccagttcgcgatcagcatcgaactcttctgtaaacaaatgggtgtgtgtatcgattaaagctaacatatgtctatctttattataaattacggttcatcaagctcaacacaaaatccgacaggttcttcttatatgaagcttccactcctaccttatccaacagatccatgctttcctgatagcaagcatttatcttatcgcgacagatatcacgaactcctaccttattatatatattagtaacagcctcaatcttctgtgcaggttcatagtgttcggctgccagccatttctgcaactcggcacgcgttgtttcatcagcctgttccaaagctgtaatcaacataaacgtctttttattacatagaatatcgcctccgatttttttcccaaagaccgcaggatcaccatacacatccagataatcatcctgcaactggaacgcaagtccggcttttataccgaaatcataaagcaactgtgcatccttttcagaggctcctcccagtatagcaccaatcttcaaggcaccggcaagtaatacggatgtcttcagtcggatcatttccatgtattcgtctaccgttacatcctcccgacattcaaactccatatcccactgctgcccgtcgcatacttccagagccgtacgcgaaaagacttccatcacctgcttcatgcacgattcaggacatccttgcatcatgaactgataggaaaggatcaacatggcatcacccgaaagaatagccgtattctcattccatttcttatgaacggtaggttttcctcgacgcatatctgccttatccatcaaatcatcatgcaaaagtgtgaaattgtgataagtttcaattgccgcagcctgtgaaaagatagcttccacatcctctttaaacaaattgtatgcaagcaacataagtacgggacgaagacgttttccacccagtccaagtacatattctattgggtcataaagtcctttcggatcgtgagaataaggcaacgattctatatatgcatgaatctgactcagtaattcctttgaagtttgttgcttcatgattcttctttttaagattatacaaaaatttttaggcacggatacacagtattcaacacctgtgcaatccgtgcctaaacaatattatctaggaaaagcttactgcaacttaaatgttacaggtactgtatattttacacgtacagctttaccacgctgcttacctggtttccacttcggcatcatcttgatcacacgaagtgcttccttatccagatacgggtctacactacgaacaacaagcgggtcgacgatagaaccatcctgatttacgacgaactgaacgattacacgtccttgtacaccgttttcctgtgcgatagtcggatacttgatgttcttagccaagaacttcaaacattcagccataccacccgggaattccggcatttcctctacgacctggaagatctgctgttcttcaacttcttcctcttctacaacttcaggaacatacttgatttcaacagcctgacctttatcctcgtttgactggatagtagattcctgtacgtttgcatcgttatcagcgatccgcaaaacttcttctactttcggagcttcggggggagggggagcttgtttaggttcttcctgttgggtgataggcaccatttcctcttcaaaaggcacatctacgataccactatcggcagtgatcacgacatcacgtttggtccattcaaacgcaacgaacattgctgccaatatcagcacgagtccgaccagaaaccatgtggttttcttgccttcaagatcggctttcggcgattttttaatttccataaaaataattttataggtttataaattctctgttccgcaaatgtaacgcaaatcttcgaatttgcaacaagataaggataaaaaattgcaaaataaattcaccacatgctatctgtcacgaaaatagactatctttgaaaactgattttcattaacattatatattaaaggtatgaacaaaatcattatcgcaatcgacgggttttcttcctgtggcaaaagtaccatggcgaaagaccttgccaaagaaatcggttatatatacattgacagcggagccatgtaccgggctgtcacactctattgtatcgaacatagattattccacacagacggaagcattgacgaggagaaattgaaacagcaaatgagcgatatccacatttctttccggttggatgccgaaacaggacgtccccgtaccttcctgaacgactcggatgtggaagaccagatacgcaccctggaggtatcttctcatgtcagccctgttgccgcactgggattcgtccgcgaggcattggtacgccagcagcaggaactgggaaaagataaaggaatcgtaatggacggacgcgatataggaaccgctgtattccccgatgcggaactgaagatattcgtcacggcatcggccgaaatccgtgcgcagcgccgttacgacgaactaaaagctaaaggtcaggaagcatcgttcgaagacatcctgcacaacgtagaagagcgcgaccgtatcgaccagacacgcgaagtcagtcccctgcgcaaggcaggcgatgcgatattactggataacagccacatgagtatcgcagaacagaaagaatggctgatgaatcaattccagcgggcaactcatgcgtaaagtagagatagacgaaagttcaggtttctgcttcggagtgactactgctatccggaaagccgaagaagagctggcaaagagtgaaacactctattgcttaggggatatcgtgcacaacgggcgcgaatgtgaacggttgaagcatctgggactaaacaccatcgaacacgatgagtttgcacagttgcgaaacacaaaggtattacttcgtgcacacggagaacctccccagacttaccagctcgcccaacagaacaacatcgaaatcatcgatgccacttgccccgtagtgcttcgcctgcaaaaacgcatcaagcaggaatttgatacgcccagccccgaaggacgggaaaagcagattgtcattttcgggaaaaacggacatgccgaagttctgggactggtaggacagaccaacggacaggctatcgtcatagaaaatctggctgaagccgagaaactggacttcaacaaagatatccggttgtattcacagactaccaagtcgctggatgagttccggcaaattgtggcatacattcaggaacacatttctccacaagccactttcctgtattacgacacaatatgccggcaggtggctaatcgtatgcccgatatccgcaagtttgcagccgaacacgacctggtgttctttgtctgtggacacaaaagttcgaacggtaaaattctttttcaagaatgcctgaaggtaaacccaaattcataccagatagaccgtccggaagaaatagaccgtgcacttctgaaagacgctcagtctattggaatatgtggagcgacctctaccccgaagtggctgatggaagcatgccgtgatacaattttgtcttactcatgacatccaaaaataaatacttttatttgcttgtaaattagttttttaatacttttgcggcatcaagattaaaacaaacaaataacttatgggaaatattaaatgtattggcatcttgacttcaggtggtgatgctcctggaatgaatgctgccatccgcgccgtcacccgttcggccatatacaacggactggctgtaaaaggtatctttcgtggatacaaaggtcttattaccggagaaatccaggagttcaagacccaaaacgtcagcaatatcatccaacagggaggaactattctgaaaacggcacgttgtcaggagttcaaaactccggaaggacgtaaaattgcttacgaaaccatgcaacgtgaaggtatcgacgcgctgattgttatcggtggagatggttctctgaccggagcacgtctgctggcacaggaatttgatgtgccgtgtatcggattgcctggtacaatcgacaacgacctgtatggtaccgatactacaatcggttatgatacagctttgaatacaattcttgacgccgtcgacaaaatccgtgataccgcaacttcacacgaacgcttgttcttcgtggaagtaatgggacgcgatgccggcttcttggcattgaacggagccatcgcagcaggagctgaagctgccatcattcccgaattcaatacagaagtcgaccagctggaagagttcatcaaaaacggattccgcaagtcgaagagcagttccatcgtactggttgccgaaagtgaaatcaccggtggagccatgcattacgcagaacgtgttaaaaacgaatatccgcagtacgatgtacgtgtaactattttgggacacttgcagcgtggcggtaaaccgacagcacacgaccgtatcattgccagccgaatgggtgtagccagcatacaggccttgatggaaggacagcgtaacgtgatgattggtatagaaaacgatgaaatcgtttatgttccgtttaccaaagctatcaagaacgataagccaatcgaccgtgaactggtaaatgttctacatgaattgtctatctaatcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgtctaatagcaaacaatataaaagaaatcaccctgccgcatcgaatgtagcagggtgattttttatatcaacaaacaaggttctatcttattctaccagtcggatgccattgtcttccagcacaaccaggcgtttcttatacagttcacctacagcctttttaaaggtcttcttgctcacgccgaatgtgttgtatattacttcggcctccgttttgtcgttcagcggagtatagccgtcgttatcctttatatactgtaacagcacttcggaaaagtcgtcgaccttcttcacgccttttttctgaagtaccaggtcaatctttccgtcttcacgtacacgctttacgtaagcatgcagatgcattccctgctccagaggctggaatatttcgttgtggaaaagcattcccgaaaatttattatccactatcaccttaaatcccaggtccgttttctgccataccagtacctcgacttcctctcccggagcatattccggacgttccttcgacaagtagtgctccactttggccgaagcaacaatacggtagctctcatcgtccagatgcacatgcaccatatagcgaccacctttctgcatcttggccttctgttcacggaaaggaacgaacaagtccttcattaatccccagttcagaaatgccccgtattggtttacccatgccacttccagacaagcaaactcccctacctgcacgtaaggttccagcgtcgtagctaccagacgttcgtccatgtcaaggtaaataaacacattcagcacatcccccggcttacaaccttcgggaacataacgcttcggaagcagaatctctccgtcttcatcaccgttaaggtacatgccgaagtctacctccttcacgacttccagctgattatatcttcctaattgtatatgactcataactattctttatttctgccaaagataacataaaaaagtaacatagcagcttctcgcaaataaaaacagaaaaaaggtatagcaaaaacacaaacccatccggcaatttatttttatcggaaaaaagaggacagttctaagtgaaaacccggcaaaattgttttacttagcagaagatttaattttttatcctatcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgtcctatgaaacactctcttttgacgctaggcatcgtggctgcttctctagccatggcctcttcttcgtgtaccacccagcaacagcctaccgaggtaacctggggtaccttcaacatccgctacgataatcctgccgacagcctcaacaactggcaataccggaaagaccatgtagccgaattcatcaagacacaagacatcgatatcgtaggtatgcaggaagtacttcacaaccagctggaggacctgaaggcacgtctgcccgaatatgccgaagtaggtgtaggtcgtgaggacggtaagaccaaaggcgaatatgctccgctgttctataaaaaaggccgtttcgaagttctcgacagtaacaccttctggttgtcacaacaccccgacagcgtaggattcatcggatgggacggtgcctgcacccgcattgcaacctgggccaagctgaaagacaagaagagcgggaagatcttcatggcagtcaacacgcacttcgaccatataggtacggaagcccgaagaaaaggagccttgctgattatcgagaaaatcaaggagattgtaggcgaccagcctgccgtgctgaccggcgactttaacgtaaccgagcagtcggaagcctacgaaaccatcacaaccaatgaatttgtactgaaagatgcctacaaggaagcggctcagcgagaaggagtaagttacaccttccacgatttcggacgcatccctgccgactcctgccagaaaatagacttcatcttcgtcactccacaaatcaaagtacaagacagttatatcccgcaggaagccaaacaggcaggcgatttcctctccgatcataatccggaagtggttcacctgtcgttctgatactccttattttatcataccatctatcatgtggatggtacggtcggtctgcgccgccagttcttcatcgtgggtaacaatgacaaaagtctgtcccagcttatcccgcaaatcgaagaacaggcggtgcagttctattttgttttgcgtatccagactgcccgacggctcatccgcaagcactaccgcaggatggtttatcaatgcccgcgctactgccacacgctgtttctcgccacccgacagttccgccggcttatgcgaagcccgctccgaaagtccgaggaagtccagcatctcacgtgcctttttcttcgcctcagaagccgataccccctgaatcagtgcaggtatcatcacattctccagtgccgtaaactccggcaggagctgatgaaactgaaagacaaagccaatttccttgttgcggaaagcagaaagctctttttccttcaggcggtttacctccgtaccgttcaatacaatccgcccgctgtcgggcttgtcgagcgtccccataatctgaagcaaggttgttttccctgccccgctgggccctacgatacttaccacttctcctttatttatagtcaggtcgattcccttcagcacatgcagcgaaccgaaactcttggttattccttccaactgaatcatacttctacaatttacgtatcacatattctgccagatagcagccaaataccgcaggcatgtagcttaccgtaccggctgtagatttcttgttctgttcgttgtctaccagaatcacggcgttcggatcggcctgttcggtactgaataccacaggcaacttgcgcttcatgcccatcttctgcaagcgtttgcgtaccgccttgctcagtccgcagtgataagtttcccataaatcggcaaagcgcacctgcgtaatatcccgcttggcacccgctcccatgctgcttacaatcttcataccacgctgcaacgcatgataaatcaggtagcacttgggagctaccgtatcgatagcatcgacaatgaaatcgaacttcgcactgtccagcagctccggtatcgcctcatccttcaggtaaaccggaagcaccgtcagctgaagctccggattaatatcgagaaaacgctgtgccagcacctccgcctttttcttacccagcaccgaatgagtagccggaagctgacggttgatgttgctgggctgaaccgtatcggcatccacaatagtcatgcgacccactccggcacggcaaatcatttcggcagcgtaggcacctacacctcccagtcctaccaccagcacatgtgcgccacgcaagcgctccattttatcggtacccagcagcagttccgtacgctgctgccaagccttactgtcttcactcatgaattcttcttaaaccatttataaaaccagttgcccaccttgtcgtaatactgcgtttcagcccatccacgtggatcagagaacgacagtgtttctgtcgggtcacccttctgttccggataaagcaacatgatactgttattattaaaatacttcgatatctgcatcggcaagcgttcgaatgccgagtcgtatgaaatggaaccgcgccgcgcactgatgatgaccagcaaatgatcgtagttcacctgtccggtcaggatgagcaggtcgtcccagttctccagttccgaataagcagcccgtgtatccttatgtttcttctgtatatagccccggatgtaccccagcgtctgaggatgcgcatagaaatgcaccctacatcccaactgactactcatacggcacatgtgggtaatccattttatgaacccatgttcgaactccgccttgggaggaaccgccacgatgattcgcctcaacgtattgaccggcatcaggaaacgggccaccatcacctgcaaatatgtatttttcaacaaattctccgtcagctttccaaagaaagaatcgacaatactcatcttacagtgcaaaccgatgatgatattcgtcgcattatattccttagccgtatgcaggatacctgtcgtaatattcaagtcgaaccgcgatacggtcttcagccgcacattggtagcagcagtaatctgtgccgcccgctccaagttacgcttgccacgcatctcctgtttcaccgagtcgttattgtcattcaccacactcagggcaaccagattgtccaactgcttttcatcgcgggctatcattgccagactcatcagactctccagcgtttccggattcgaaaccggaataaggaatgtttccttctcctgcgtcttctctccgtccacctccgcatcgtccatggcaatacgtttggcagcatgttcggtaatgaaagagctcaccacgcaagtcaccagaattagcagaattgttccgttcagcacatcctcgttcagcagacgttcaccgtctggtaaaataatgttataaccaaccagcacggcagccagcgtagcagccgcctgtgcgttacttaatccgaacatcagctcccgttccagcgaacgcatcttataaatcttctgcgtgagccacgacgcaatccacttacccagcaaagccacgataatcatcaccaccgccactttgagagagtcgatatgtccgaacagtacgttcacatcaatcaacattcccaccccgatcaggaagtacggaataaacaacgcgttgcctacaaactccagatgactcatgagcggcgagacatgcggaatcagccggttcagtaccaatccggcaaggaaagctcccaagataccttccatacccacaaactccatcagtcccgcaccgaggaacaccattgccatgacgaaaatatactgcaccacattgtcactatagcgacggaagaaccatcttccgatacgcggaaaagcatacatgatgactacactcagcaccactaccttcagtaccagccagatccagaacatatccgacgtttctcccttgtacataccccctatcacagccagcaccagcagtgtcagcgtatcggtcacggcagtacctcctactgcaatgcttacagcccgctgacggttgataccgtaacggatcacgataggataagcaatcagcgtatgcgaggcatacatactggcaagcagcaccgaagtggtcagactataatccagcagatgcagattggtccatatacctatacccaaaggaaaaataaacgcgagcagtcccagcacggtagccttcacacggatactcttgaagtcctccatgttcatttcaagtccggcaaggaacatgatgtaataaagccccaccttaccaaacagctcgaagctgctgtcgcgtgccagtatgttaaacccatgttcgccaatgacgactcccgccagtatcataccgataatgtggggaatacgcagccgctccagtacgatgggggcaaacaagataataaccaacaccaaaaagaaaatccacgtggggtcggtgacaggaagatgaaaatcaaagtttacaaaatcgagcacttctttcataaataggtattactatttcattttagaaacaaaaatacaaaaaatcttcctattttccgtattaataattcagaatgttttatttttgcaatcggaaatccaagcagacaaaacacagcgtttttaaatcaatgacttttttgacaaagcgaagagaaaagcgtctgcacattaagaaaaatgtaattattaacagtttaagaattaagagatgaaagtagctattgttggtgcaagcggagcagtaggacaagagttcctgcgtgtgcttgatgagagaaattttccgatagacgaattgttattatttggctctacacgtagtgcaggacgaaaatacacattccgcggaaaagaaatcgaagtgaaactgctgcaacacaatgacgatttcaaaggtgtcgacattgcctttacttctgcaggagcaggcacatctaaagaatttgccgaaactatcaccaaatacggtgctgtcatgatagacaattcaagcgcattccgcatggatgcagacattcctttggtcgtacccgaagtaaaccccgatgacgcattgaaccgtccgcgtggtatcatcgccaacccgaactgtacaaccatacagatggtagtggcattgaaagctatcgaaaaactgtcgcacatcaagcgcgtacatgtttctacttatcaagctgccagcggagcaggtgctgccgctatggacgaactgtacgaacagtatcgtcaggtacttgccggagagcctgtaaccgttgaaaaatttgcttatcagctggcgttcaacctgattcctcagattgacgtgtttaccgacaacggttataccaaagaggaaatgaagatgtacaacgaaacacgtaagatcatgcactccgacgtgaaggtcagtgcaacctgcgtacgtgttcctgcattgcgttctcactcagaaagcatctggatcgaaacagaacgtccggtatcggtagaagaagcacgcaaggcgtttgccgaaggtgaaggactggtattgatggataatcctgaaaagaaagaatacccgatgccgttgttccttgccggaaaagatcctgtatacgtaggacgtattcgtaaggacctgaccaacgaaaacggcctgacattctggattgtgggcgaccagatcaagaaaggagctgccctgaacgccgtacagattgctgaatatttgcttaaagtgaagaatatcggataagtaatttttcactaacagatacgaaagagataaggcaacctgcctgtccggacgaatgcatcgctggacaatgcggttgccttatctctttttagttttatcctcctttttctttcaacatgcaatacacctatccttacctctctcccctcggaaaaatcattcttgccagcaacggcacatgcctcaccggattatggttcgaaggccaaaagtattttggccgcacgctggatgcggaacacgaagaaagagattttcccgtgtttcgtcagacaaccgaatggctggacacttactttgccggaaagaggcccgacttcatgcccgaactggaactgcatgacacgccgttccgcttagctgtatggcatatcctgcaacaaattccctatggcgaagttatcacctacaaagaaatagctcaggaaatagcccgtcagcgaaactgcggaagcatgtcggcacaggccattggtggagccgtcggccacaatcccatcagcatcctcatcccctgccaccgtgtaataggcagcaacggaagtctgaccggatatgccggaggagtttcccgaaaaatgagtctgctcgcgctggaaggtgggacagatctgaacaccttcaaataaaatcttacataccggatgcttcggcctgcttctgcatgatgtcctgtaccagatagtgactagtcctaaataaccgttacagttattggacaaaaataaattatttatcacagttcagcaaggtcagtcttgctgaactgtttgtttttgtaacttttaattttaatcagcttctgatgatgcatatactccggcgttttatacccacaagagtaatgaggtctgatgttattatacttgtagacagcatcccttattacctgtttcatatctgatagcggtagattaagttcctcaagcaggaactcctgttttagtattccgtttattcgttctgccacggcattagcgtacggatcgtaagattcagtcatgctgggtatgatgtgatattgtcccagtaatttctgatatgcatcggaacagtactgtataccacggtcagagtggtgtatcaatggcgtgtccctatacagtcggttgcggtttgccatcctcagcgcgttcaaagaaccttgagtgtccaaggaatcggaaagatcatatcccataatcttcttggaataagcatctgtaaccagagaaagatacatatgccggtttctattgccaatataagtaatatcagaaacccatatttcttccgggcgtgtcgcttccatactttctacaagattcttgtgcttccgaaaccggtgatgcgagttggttgttacatgatatgaacgtacgggctttataagcagacggttggcacggagtatatcgaacagtttgtccctgcctaccttgttctccttaagtggctgatgaagcatatgataaagtttgcgggttcctacacgtggcagttccattcggatatctcgtaccatgcccacaacatcagtggccctttgccggcctcggattatcttccattgctgacggtaatatttctgcctgcttatcccgagcagtcggcagattccgctgatacttacggatttttcttctttatatttattgactgttcgggagaggagttttttcgtatgtcgatattatattccttttccgctatgtctatcatcatgtcgaaaaactctgctttcatatccttcagctcaagctccttttccagacgggcattcttgcgttccaggaaccttactttctgttgtagttctaacagtttttgatccttactcttttccatagaatggtaacatttgtttgtgatatcaaagttaccatatttttcaatccaacggctaatagttgaacatccttgtatcccatattttcgtttcagcgctcccaaacttatttttgtggtttcatactcttgcactactgatagtttaaaggacatactgtaatctttttgtgtgcgcttaacgtactttgtttctgtcttttccataatgttaccttttttgttgtaacgctatttcaggactagacatagagattaaaaaagagagagtttgaaattttatagaaatctattctttggtagtattttttatttaggtatctgcatatagagagtaatacgaattttatgacaaggttgtttatgtgggttggaatactggctacgtctttaacatcaccattacaggcccaagtttcttccgatacagtagccatcagtcgggaaactgccattatttttcgttttatgcccgggaagctgatgtcttacgcatcttttagcgaaaacgaacaagcgataaagaagctgggagagttgatggacgaacacaaggatgagatcgttcaggaaaatgcttttgtcggcattcagggcttttgcagttcctttcctacggaaaaagaaaatatacaggcggtcagaaaccgtaccaatcaggttaaatcttattttatcgcatctaccgacaggcaggtaaagctggatacggtgcgctgggcatgtacggaagaggaaatccgtgagcggacttatccgaactcgataaccggtgccagaaaagagactgtcgtgtatgaagcaactgaacgtgattcgtttgtgcaggaacaggccgtacagggtgatacctctaccgttccggcagcatacgaataccgtttcacgccctggtctgtcaagaccaacctgctgtacgatgtcttgctgaccccctctctcgaaatagaataccgcatcagcaagcgttggtcggtcggtttggaaggagctttggcaagctggagcaatgccaatcgtcacagatattaccacctagccttcatcagtccggaggcacgttactggtttcaggctccggaacgccggaaaggacattacgtcggcttgttcgcggggggcggctggtacgatttgcagaacggaggacgcggttacagaggcgagggaatgtttgctggagcaagctacggctatctgtttccggtaggcaattatttctcgttcgaggctggcattggcataggatatctgaatacgacctacgatgaatatctgccggtgaataaagattatgtctatcagcagaccagcaagatcaattacatcggtccgctgaagttgaaattcgcatgggtatggtacatcggacgatgcctcgaaaagaagggaggaaacgcgtgagaattacgacaatgatacgctgtgctgccatactgttgttggtggcatgcactgcctgtcggaaggaattgtactaccatgacgatgaccatgctttgacggtaaaagtatatgccctaaccagttggaaacaagaatgggagcgtacgcacagttataactggaaagagtcgtggctcgacgagtttcgttatacctacgatgccctccgtcccgataaagccactggcattaaggccacggtgtatggcgacgatggctatagcggagaattgcaccttcctgccgaagggggaaagctgccgctgcgtgaaggaaaacatgctgtcctgctgtataacaacgatacggaatacatcgtattcgacgggctgtcggcttctacctcggcaacggctacgacacgtacacttactcgtgccagcttaggagcactgcataaaggtgaacgtaccatcaatcagcccgaccagctctatgcgcattacctggaggaatgtaccggcgaaaaaacactcgagaaagtggaacttcccgtaacgatgcatccgctgacttatacttatctgatacggtataagttttcgaagggattgaaatacgtggcactgacccgtggggcactggccggcatggcagagaaggtttatttgaacgacggacgtacggggagtgagaccgctaccatccttttcgattgcagtcagaccgatttcggggcggatgtgtgtatgaagtgtttcggcgtaccgaactatccgggcgatcattacatgcgtgccgatggtactccggtgtactatacgcttaaccttgaagtccgactgaataacgggaaggtcctgaattatgagtttgatgtgaccgatcaggtgaatgcccagcctcgcggcggtgtcattacggtagacggaatcgaagtagacgacgaggacggtatggcaggttccggagggttagacgtcacggtagacggatggggcgattatatggatatacctctgccgttaggataacggtcggataatttgttgaatagcaatagaacagtaatatattttttaatttaaacatttatttttttttaagatgagaaaaagtttatttttattgggggtaactgtagcaacattgtcgagctgtacacagagtgaggtacttgaagtggcaggcagcaacaaggctatcgggtttgatgcttttgtaaataaaagcattagagcggatatcacgaccgacaacatcaatcattttaaggtgtttggtggatacgacggcaattatacaaatgtattcaacgatgaaaaggtaagtggcagcaaaggttcttggacttacgataatacccagtattggacgaacggaaagacttatacattccaggcatatgcaccggaaggagctacggcttcggcaacagcaaacggtgtgaattttacaggtttcgctgccgacggaaaaactgaccttctggtatctggtgtgaaaacagtatcagaagtcaatactgcatcggacccggaaaaagttcaattttcgttccgtcatgtgctgtctaagataaagtttacattctctactacactgaataatgtaaatattgccatctctgatttgaaagttcagcaggtacccaatacaggtaattataccaacagcggttctaccggatcgtggggctctccgagcggtacgaaagattacgacctgacagttgcggaacaggtaaccaagagcaatgcaaaatcgagttcggaatgtctagtcctgaaatagcgttacaacaaaaaaggtaacattatggaaaagacagaaacaaagtacgttaagcgcacacaaaaagattacagtatgtcctttaaactatcagtagtgcaagagtatgaaaccacaaaaataagtttgggagcgctgaaacgaaaatatgggatacaaggatgttcaactattagccgttggattgaaaaatatggtaactttgatatcacaaacaaatgttaccattctatggaaaagagtaaggatcaaaaactgttagaactacaacagaaagtaaggttcctggaacgcaagaatgcccgtctggaaaaggagcttgagctgaaggatatgaaagcagagtttttcgacatgatgatagacatagcggaaaaggaatataatatcgacatacgaaaaaactcctctcccgaacagtcaataaatataaagaagaaaaatccgtaagtatcagcggaatctgccgactgctcgggataagcaggcagaaatattaccgtcagcaatggaagataatccgaggccggcaaagggccactgatgttgtgggcatggtacgagatatccgaatggaactgccacgtgtaggaacccgcaaactttatcatatgcttcatcagccacttaaggagaacaaggtaggcagggacaaactgttcgatatactccgtgccaaccgtctgcttataaagcccgtacgttcatatcatgtaacaaccaactcgcatcaccggtttcggaagcacaagaatcttgtagaaagtatggaagcgacacgcccggaagaaatatgggtttctgatattacttatattggcaatagaaaccggcatatgtatctttctctggttacagatgcttattccaagaagattatgggatatgatctttccgattccttggacactcaaggttctttgaacgcgctgaggatggcaaaccgcaaccgactgtatagggacacgccattgatacaccactctgaccgtggtatacagtactgttccgatgcatatcagaaattactgggacaatatcacatcatacccagcatgactgaatcttacgatccgtacgctaatgccgtggcagaacgaataaacggaatactaaaacaggagttcctgcttgaggaacttaatctaccgctatcagatatgaaacaggtaataagggatgctgtctacaagtataataacatcagacctcattactcttgtgggtataaaacgccggagtatatgcatcatcagaagctgattaaaattaaaagttacaaaaacaaacagttcagcaagactgaccttgctgaactgtgataaataatttatttttgtccaataactgtaacggttatttaggactagtcagaaattattgtcatgcctcagacattttctcaagggctgacggtttcatttaaagttacggttaccggaggattgtcgctgacagctgatcataccgtgacactgcctaccacagcatgggaagaaggcaaatgctacaattacaaggctgagctgactcctgagaacatcgacccgctgaacccgttgaaacccgttgagtttggtgatccgactgtggatggttgggagccgttcactgatgatgatgttaccgttgctcaaccttaattttaagcatcggatatagatatactgattgagcattaacagcaagaggatgcatccgttacagggtgtgtcctcttttgtattgtcataaatatcattataaactataccctaaaaaaacaaatactctctttttcctcattcataacaaacacataaattttggttatatggctattatatttcaacaaatagttacaaatacacttatacaacaaaacaattctctttttgtttgccgaaaatctgcacaaaaaatcctcttttttcgttccaaaagtttccagcagccgataaagccgtcttatacaggcttatagaagctagtcgacatgaccttttttttcggaatacttcattaaaaagtgtaaagagaacacgaaaactgctgcaatcggtatttttcaacgcacggcaagaaagggagattacatttttttatacctttgctctggtaagcatgactgatcataaaaacaagcatatctacacaatgaaaaaactgattgcattattctgcctgctggctttcgtcatcggagtgcaggcacagcgtaaggtcagcctccaggatgtggcacaaggtacctatcgtgcacagaacatctacggcatcaagccgatgctggacggcgagttttatacgcaaatgagtgctgataagaaacgtatcgtgaaatactcgttcaagacgggcaaggaggtaggaacggtattcgacgtgactacggcaagagattgtccggtcaagacattcgacgactacatcatgtcgcccgacgagaaactgattctgatccagacggaaacgaaacctatctatcgtcattcgtttacagccgaatattacatcttcaacgtgagaaacaacaagatggaaccgctttcgaaaaacggaccgcaacaggtgccgctgttctcgcccgacggttttcaggtagctttcgtccgcaacaacaacatttttctggtcaagctgttgtttggcaacagtgaatcgcaggtcactaaggacggtgaatacaataaggtgctgaacggtatccccgactgggtgtacgaggaagagttttctttcaaccgtgcgttcgacttcagtgctgacagcaagatgattgcttatatccgtttcgacgagagtcaggtaccgatgtacagcttcccgtggtacaagggtatggcgcccgaaaagagccagtatgccacttatccgggtgcgtacgaatataagtatccgaaggcaggagaagtaaactcgaaggtgagcgtacatacgtacgacatcaagagccacgttacccgcaaaatggatctgccgctggattccgacggctatatcccgcgcatcaagtttacgtccgatccggaaaagcttgccatcatgacgctgaaccgtcatcagaaccggttcgatatttacatggctaacccgagaagcgcgctgtgcaagcttgccatccgcgacgaagctgaacagtatatcaaggaacaggcttactccgatatcgtattctatccggaacatatcgtgatgatgagcgaacgtgacggatataaccacttgtatctgtataccatagccggcaatctggtaaaacaggttaccaagggtaaattcgaagtgaaggatttcttaggttgggacaagcagaccaatacgttctattataccagtaatcaggaaagcccgctgcgtacagctgtctacaaaaccgatgcgaaggacaagacaaccaagctgtctactcgcacgggaaccaattcggctatcttcagcagcgacttgtcgtactatatcaacaagttctccaacatcgatacgccgacgctgattaccgtcaacaacaacaagggtaaggaactggctacgctaatggacaacgcaaagctgaagtcacaactggctacgctgaacatgccgaaaaaggaattcttcaccttccgcactaccgagggagtggaactgaacggctggatgatgaagcctgccaacttcgacgcgagcaagaagtatccggtcatcatgcaccagtacagtggtccgggctcgcaagaagtgcttgatgcctggaacatcggaagttccagcgacggaggtatgtttgaagcctacatgtgcgacaaagggtatatcatggtctgcgtagacggacgtggcacgggcggacgtggtgccgaatttgagaaatgtacgtactgcttcctgggtgtgaaggaatcgcacgatcaggtggaagcagccaaatacctagcttcactgccctacatcgacggcaatcgtatcggtatctggggatggagctacggaggttacaacacgctgatgtcgatgagtgagggtacgcctgtcttcaaagcgggtgtggctattgccgctccgagcgactggcgtttctacgatacggtctataccgaacgcttcatgcgtaccccgaaagaaaacggtgaaggctacaacgccggttctgccattctccgcgctccgaagctgcacggcgacctgctgctgatacatggtacggccgacgacaacgttcactaccagaactgcgccgagtacagtgaagcactggttcaggctggcatccagttcgacatgcaggtgtataccaaccgcaaccacggtatctcgggcggaaatacccgtaatcacctgatgaaccgcgttgccaatttcttcatcgaaaaactgaaataaactatttgtatcatacagagttatgaggaattaaaaggtttcgcccagacattgcggcggattttaattcctcatttctcgtttttatcccttaacgctatggaacacgtaaagaagcccgaatggctgaaaatatccatcggtaccaatgcccgctataccgagaccaaacgcattgtcgatacacataaactgcatacgatatgcagcagtggacgctgtccgaacctgggagaatgctggggaaagggaacggctacctttatgatagggggtgccatctgtacacgctcgtgcaagttctgcaacacgctcagcggaaaaccgctcccgctcgatgcacaagaacctgcccgtgtggccgaatcggtacggctgatgaagctggatcatgccgtcgtcacctcggtggaccgtgacgacctgcctgacttaggggctgctcactgggcggctaccattcgtgccatcaaggagctcaatccgaatacgacgctggaaacgctgattcccgactttcagggacgggaggaactgatccgcatggtgaccgatgcccgcccggacatcatctctcataacatggaaaccgtacgccgcatcactccgctggtaagaagcgtggcaacgtacgaccggagtctggaggtgatccgccggatagccgaaagcggcatcactgccaagtcgggtatcatggtgggactgggagaaacacccgacgaagttgagcagaccatggacgacctgctggccaacggctgccgcatcctgaccatcggacaatatctccagcccagccggaaacattaccctgtacacgagtacgttacccccgaacagtttgcccgttacaaggaaaccggcgaaaagaaaggatttgccactgtagaaagcggtccgctggtacgttcttcgtatcatgccgaaaaacacatccgctacaagtgaacaattcggaaaagaaccttgttacacctataaaaaaatcaaggcagatgatgaaacttatattgaaatacagaaacaagattgtatcgctcggactattacctatcatagcaacattgatttgtttgcattttttccagaataccatcgtactgggaataggcttcgcagtctgtgtcggtctgctgttgtatggcatcatccgcctgaaggatctgaattttttcctgctgctgggtagtgtaggcataggagcctgcttcgcattgcgcctgttcaccggctacgagtttgtaccgctgggaagcatcactcctattctggagctgctgctgctcatcgtggcattcatccacatcacggcacccgaagtatacaaggaattacaggagcgactgcacctgaggaactgcttctcgttcgtgctggaggcaaagaccattgtcattctctcggcattgcatctcacgattctgcttttcgtcgaccacatcgaccatctgttttcggaagacggttccttcttcctgatgtacggcataccagttattatctatattctctgtctggttatcaacgtggtaggcattcatctggcacttcaggagaatttccgttacagtctggtacgcattgcagtggttcacgacggaaagatttacctgaagcagcgcaatgactgtaccggcaatgataccgagggaactcccgtatgggacatcgccgtggaaagtccgttcgaaggaccgctcgacaagagcaatgaatatgccgcacgcattgccaaaaagatatgcacctcgaagcacatcagtccgcgcctcatcctgagatacaccactactcccagcgatgccgatacccggcagcgcgtatcgctgtacattcttccgcttcaggacaaggacgaactccgcaaggcgaccgaaggcagattcttttccttcgacgagataaatgaaaccgccgtacggagatacaatccagccctgctttcggaactggatgccctgcagatggcggcggaaatgtggcagacattcggcagtgccgactaactgcttcttacttataaatcaaaaagatgcacggaatctttgtcaggtcgggcaattgcttcttccactcctgaaccgttttggtcttaatatactctccctcgcaggtaatgttggcagccacgcagaccttggtttgcggacggcaggctttcagaatgtcttccagcatcttgttgttgcgatagggagtttcaatgaaaagttgtgtctggtgctcgctgtacacacgctgctccagttccttcagccgtttctggcgttcgcccggctcgatggggagatagccgtggaaagcaaagctctgtccgttgaatcccgaacccatgaccgacaggatgatagacgacggtcccaccagcggaaccaccttgaggttcttgcgctgcgcgatggctactacgtcagctcccggatcggctacggcaggacagccggcttccgaaatcacccccatggaatttccttcctgcaaaggcttcaggtaacccgaaatggcttcgggcgaggtatgcttgttcagcggataaaacgtcagttcgtcgatgttgatgtcacggtctacctttttcaggaaacggcgtgccgagcgcacatcttccacaataaaatgacggatctgaagaataatctctttgttgtacgaagggaggactttctctaccggagtatcgccaagggtaaccggcagcaaatataatgctgtatccatgtaatctatattctaatttgttctagctcagtctaacgtcacgttgccgagatcggtacgttccagcaatgtggcaatgcttacgtcgggatgcttcttcatgtacctttcggtcagccgcatgcccagccacagcccgacaacaggaggcagtttctcaccgttgagaatcatgttcgggtcggaatgagtgtaggcacggatcagcatcgggtcggtactgctcagatgacctcgctcagccatccacttcaacagttcctttccatgctccttgcaccagttctcctccttttcggtatatcccagcgcttcgccgttcgtcttgtagccaagtgcctgacgcaccacccagtgtatctttccctgatgcaagatgacatcgtacagcgaacggtgccccggacgccactcgaaaggatacaagctaagcagataaaaagtaaagcaatcgggaaggatgcgctcgggtgtcatcgaccggcgctgataatcataataataccgtcggtaaagcggatagttctcccccatgtatttatcgaggctgaaccccagcagactgtcgcccaccactaccgactggttcaaggccgagatttgcgaatagaccgccggtacgggaaaagcgggaatctcctctttcaggaagcggaacccgtcggtaaatcccttctcgagggtagtcatatccttgaatttctcggtagcatcctgcatgatacggagcagaatggtatctgagtaataagcacacagcctttcgttgatgttaggttcgtccacacgccccagcatgagcacatcctctatcaggattttggtggcacgcggacagtcgaggctcattttctgcaaggcagccaggctgttcatggctgtagcctcgtactgaagacggtcgtaacggaaaacttttatacccttatcaagcaaaacatcgtcgccttgctctcctgtatggcaggaaacaagtacgacgatgctcagtaatatgaatataaattttctcatgtaaacagttgtccgtcagcttttatccgtagataatatgtccattttcgtctttgtattcatccagacccttttcgtaagtagccatggcacgaagactcatacctacgctggagaaacctccgtcgtggaacaagttctgcatagtcaccttgcgtgtcaggtcggagaacattacgatacagtaatcggcacattcgtcagccgaagcgttgcccagcggcgacatacggttggcaaagtcgaacagtttgtccataccctttacacccgatccggcagtagtcatggtaggcgactgtgagatggtgttgatacgtacattgtgttcacgtccgtagatgtaaccaaagctacgtgcgatagattccagcaatgccttggcatctgccatgtcgttgtaaccgtagaatgtacgctgtgcagccacgtagctcaatgccaggatagaaccgtattcgttgatggcatccagtttcttggccgactgaatcattttatggaatgaaatagctgaaatatccagcgtcttgttcaacatatcatagtcgaggtcatcgtaagtacgtttcttgcgtacgttaggcgacataccgatagagtgcagtacaaagtcgatcttgcctcccaatacttccatcgaacgcttgaaaacattttccaagtcttctacgctggtagcatcagcaggaatcacttcgcagttcagtttttctgccagtgcggaaatctcgcccatgcgtactgcaaccggagtgttcgacagcgtaatcattgctccttcttctacagccttttctgctactttccatgcgatagactgttcgttcagagccccaaaaacaatacctctttttcctttcagtaaattataactcatactttttttattataaatttggggacaaagatacaaacaattctggtaactctgccatattcagacattaatctgcaaaaataggacaatattcccccctatcagacgaaataatacatattttgtcaattttttatagggaaaaaagatacaaatgcacatttttttcacctattcagtcaaaatattcacatcattttcaaggaaagcccgtaactttgtgacaaaagcaagaggtttttcataatatttattaaggttagaaattaggttataaaaagtctttattatcctgtctgtcaatcttctgcgagagaatgttgacaggctataaggataataactaataagaaaagcttctatattatatataaagaaacctaagcaaaagcaagaagaacaaaacaaaccaatatatcactaaacataataatacgctcatgattacactgaacaattttttcaaacaatgggtattctctataggcattgctacccttgcattaggatttccggctcgtgtagctgctgagaacatgaacgacacagataatatctacaatgaacttccgttccagatgaatgcagtacaactgccagtattcctcgattacactcgctccatcaccgaatttggtgctgtagccgatggcatcaccctcaatactgaagctttcgacaaagccatcaaggcggttgccgagaaaggtggcggaaaggtaatcgttcctgccggactctggctgaccggaccgatcgtgctacaaagcaacattcatttatatttggaagaaaacgcgctgatcttgtttacagccgaccatacacagtatcctatcatcaagacatcgttcgagggactggagacacgccgttgccaatcgccaatatcggctgtcaatgctgagaacgtggctatcaccggaaaaggggtcatggatggaaacggagatacatggcgtccggtaaaaaaaggaaagatgaccggtggccagtggaagagactggtcgcttcgggaggcgtactcgataaggccggagaagtatggtatcccagcgaaggttcaatgaagggtgccatggcatgcaagaacttcaacgtgcccgaaggaatcaataccgatgaggaatggaacagcatacgcgactggctgcgcccggtactgctgagtttcaaaaaatgtaaaaaggtgctgttgcaaggcgttaccttcaagaactcgccaagctggtgcctgcacccgctgtcgtgtgaagacattaccattgacggagtaacggtttccaatccgtggtactcgcagaacggcgatgcgctcgacctggagtcgtgcaaccgtgcgctgattgagaacagcagcttcgatgcgggcgacgacggtatctgcctcaagtcgggtaaggacgaagacggacgccgccgcggtgagccttgccagaacgtgattatccgcaacaatgtcgtgctgcacggtcatggcggcttcgtagtgggtagtgaaatgtcgggtggcgtaaagaatatctatgtagacaactgtacatttctgggtacagacgtcggactccgcttcaagagtacccgcggacgtggcggtgtggttgagaatatccatatcagcaacatcaacatgatcaacattccgaacgagggactgatcttcgacttgttctacggcggcaatgctccgggtgaaggtgacggatacaacaatcctacgaacgaaaaggtgcctgccgttacggaagaaacgccggcgttccgcgacatcttcatcaagaacgtaacagccaagaatgtaggacgcgccattctgttcaacggtctgccggaaatgccgatcaagaacatacacatcgaaaacgtcacgatgtcggatgccaaaaacggtgtgatactgaaccgtaccgacggagcaacattgaaaaatgtcaaaatcataacttcaaagggtggcaacaacctgaaactacagaatgtgaaaaacgtaactgtgggtaataaacaatataaggaggtaggaaatcaggctgaatcgtatacattctgatccgggttccttcctgaaaaggacgacaaagggtctgtaaacatccggttcaagtattccgacttgctgcttatgtttgcagatcctttcttccttttacttttttacgataatcattttatcttccaaggagaactttccggtctggcttgtccggacaacgaggagtttgaccgagcgaaaactaaaaaattgaacgtagcatgaaaatcatctcaatagcctgcctggcactgctgacaggaggactgagtgcttcggcacaaggtttggaaaagaaaattcaggtcgtggtggaaaatccatggaacgccgaaaaggtggacgagccggtggtaatcgacctcgggagtctgggtaccggatttacggtcaagtcggctgtcgtacgcgacggtagcgtggagataccttcccagctagacgacatggattgtgatatgcgtgccgacgaactggcttttgtcatcaacctgccggcttcgagcaagaagacactcgacattacgctttccagtctcaagagcgacaagcaatatccggcgcgtgtatatgccgagatgttgttccgcacgtcgaagaaaaacaagtatgccaaggggtatgccatttatgccgacggagcttcggacacgtacaacgtgcagcatcatcacggggctgccttcgaaagtgaactggtggcgtatcgtatttatttcaacgagaagcagacaaccgacttgtacgggaagttccataaggggctggaactggaggatagtcagttctatcctaccgacgagcagctgaagcgtggcttcggagacgatgttatcaaggtgaacagcagttgcggagccggaacgctgaggggctgggacggaaagcagtctacgctcatcaagccggtagccgtacgcggacagcgcatcttggcttcgggaccggtacgtactgtagtcgatgccgaggtgaaaggctggcagtatgccggaaaggaactgaacatgataaaccgctatacgctgtatgccggacaccgcgacgcacaggtggatgtgctgttcgacgagccgctggacaaggaagtattctgtaccggcgtgcagaacattaccggacatgctgatatgttttccgaccacaagggactggtggcaagctggggtaccgactggccggtgaacgatacgataaagtataagaaggaaaccgtgggactggctacctgcattccgcagaaatatgtggtgaaggaaacagccgacaaggagaatttcctctataccgtcagtgcccccggacaacgttcgttccgctactatacctcgttcacctcgtgtaaggaaaccttcggatatcccgacaaggagaaatggtttgcctacgtgcaagagtggaaaaaggcgctggaacaacctgtccgcatcaccatcgtaaagaaatagaacagtcacaacactaacacaaatctgccggcacagaaaaacgttattaaataaataaaaaagccggtaagtcagcttcactattcgtctgattgaacagtgaagctgattgtatgaaaaacaattcattaacttaacatcgattacctatgaaagctatcgtattttctatcttgctgggaagctgtctcgttcctgccgtacaggcacagaactatgtgtcgaaggtatgggtggccgatcaggggaacggcacatacaagaatcccgtgctgtatgccgattattccgaccccgacgtatgccgggtgggcgatgacttctatctgacgtcgtccagctttggctgcctgccgggattacagattctacactccaaagacttggtaaactggaccatcgtgggagctgccgtaccgcggtcgctggctccgcataccgatacggctcctcagcacggcaatcgtgtatgggctccgtgcatccgtcaccacaaaggcgagttctatattttctggggtgatcccgatcagggtatcttcatgaccaaggcaacagacgtcagaggtccgtggtgcgaaccggtgctggtcaaagctgccaagggcatcatcgatacgactccgctgtgggacgacgacggacgggtgtatctggctcatgcctatgcgggaagccgtgcgggactgaagagtgtgattgccgtatgcgagctgagtgccgacgcgacccgtaccatcggaccgtcacgcatcgtattcgacggtcacgaagcgcatcaaacctgcgagggaccgaagttctacaagcgcaacggttattattatattttccatccggcaggcggtgttcctacgggctggcaggtagtactgcggtctaaaaacgtatacggtccctacgaatggcgaacggtactggcacagggaaacagtccggtcaacgggcctcatcagggtggatgggtagatacgcccagcggagaagactggttcctgcattttcaggatgtgggggctgccggacgactggtgcacctgcaaccgatgaagtgggtagacgactggcctgtcatcggtgaggacaaggatggcgacggttgcggagagccggtactgacttaccggaaaccgaacgtaggcaagacataccctatttgtacaccgcaggaaagcgatgagttcgataccaacgagctgggcttgcagtggcagtggaatgccaacatcgacgacaagtggtattttgccgatcaggaacacggggtactgcgtctgtattcgtatccggttcccgagacctacaagagtctatgggatgtgccgaacatgctgttgcagaaattccccgcccccagtttcagcgctaccttgaagctgaagttctcccccattgccaagtacaaaggcgaacgtaccggactggtggtaatgggtatggactatgcgggtatcgtactggagaataccgaaaacggactggttctctcgcaggtagaatgtaagaaagccgaccgtggaggtcaggaaactgtcaacgaaacacttccgctgaaggaacatgaaatctacctgcgtgccgaaatcaccactacgggcgagaagatcagcaagagcgaaggcggacacgacctggtagtgatgtgccagctgagctacagcaccaacgggaagaagttccataagttcggaaaagaatttcaggtgaaggaaggcaagtggatcggtgccaaggtaggtacgttctgcacgcgtccagccatcacgaccaacgacggcggatgggcagacatcgactggttcagaatagacaagtaatatctcctgattttttacaaaaaataaaaaaacatgcccgtgttttccggaaaacttgccgacgttttcggaaaaatatgggcatgtttttttcgtacatcaggcacgttctttttgcgcattggaaaatactttcacttatccgcacatttttccctcatccgcacaatacactttctctgctaatcgcaagacatatattttttgctcgctagcacagcatacatttttcactcaccgatacaatacacttcttctaccaatcgcaagacatatattttttgctcgctagcacagcatacatttttcactcaccgatacaatacacttcttctaccaatcgcaagacatatattttttgctcactagcacagcatacattttccattcactagcacagcagcgcaccttttccgctagcaagcacaatacaaaaaaggcccggaaatctcacgacttccgaacccctatatgcaaaaatacaaaatattattcttatgattcttttacttcccaacccagtgcgctggctcccaatacggcagcatctgcgtccttcaactgagaaaggagtaatttggttttacccttgtagatgttcagcacattttcttcgagggctttcttgataggcttcatgatgtagtcgcccgacttagccagaccgccgaacaagatgattgcttcagggcttgagaaagctacaaagttagccagagcagttcccagaatggttccggtatattcaaagatattcatagccagcttgtcacccttcacagctgcatcgtatacatctttcgactgaatttcttccgacggaatgtttctcagcaagcttggttcagaacgtgcaacgaggaattcacgtgctgtacgagccacacctgtagccgagcagtaagtttccagacagcctttacgaccgcatccgcactgacgacctgtaggatctacgataacgtgtcccagctctccggcaaaaccatcgtgaccgtaaaccagctgaccgttgataacgataccgctaccaacaccagtacccagtgtgatcatgatgaaatccttcataccgcgagctgcaccgtatgtcatttcaccgatagctgccgcattggcatcgttggtcagtgccgtagggatacccagacgttcttcgaacatggcagccagaggaataacccccttccatggcaagttcggagcaaattcgatagttccactataatagttaccgttaggagcacctactcccatacctttaattttttctgcaccgccgaattgctggagcaacggaagaagtttcttgcatacagcgtctacatattcgtttacatcactgtactgctgtgtttttactgaatcggaagccagtacattaccacgagaatctaccacaccgaaaacagtattagtaccaccgatgtccattcccactacataggttttttccatatttattgtcatgacattaaattgttaaaggttagttatatgtggcaaatgtactcaatcggagaaaaccgaacaaattttttgataagtttatttaaccctgatgtaactttttatatcttagccgcgtctaacgatacgtagttcaagacactaaatacattccaatatgatacgattacagggcatcaacaaaacatattataacggagcaccgcttcatgtactgaaaggcatcgacttacagattgataaaggagaatttgtttccatcatgggagcttcggggtcgggtaaatctactttactaaatatattaggtattctcgacaattacgattcgggggaatattacctgaacgacgtactgataaaggatctgagcgaaacgcgcgcggcagagtaccgtaaccgcatgatcgggttcatcttccagtcgttcaacctgatttcgttcaagaatgccatggagaacgtggcactgccgctgttctatcagggggtgggacgaaagaaacgcaacgaactggcgatggagtatctcgacaagctgggactgaaggaatgggcgcatcacatgcccaacgagctctcgggtggacaaaagcagcgtgtggccatcgcacgggcactgatttcgaagccgcagattatcctggccgacgagccgaccggtgcgctggacagcaagacctcggtggaggtgatgaacatcctgaaggagctgcacgaccgggaaggattgaccatcgtggtggtgacgcacgagagcggggtggcaaaccagaccaacaagatcattcacatcaaggacggggtgatagaacggattgaagacaacatcgaccacaatgcctctcctttcggcaagaacggtttcatgaaataaacagacggttatgacagacttgatacaagaaatatacggtaccatcatgcgcaacaagctgcgtaccattctgacgggcttctcggtggcatggggcatcttcatgctgattgtgctgctgggtgccggaaacggactgatacatgccttcgaaggacagtcgagcagaatgaagatgaattccatcaagatttatccgggatacacgtcgaaacctttcaagggacttcaggagggcagacgcctctcgctcgacgaaagcgaccggcagctcaccacagaggctttccccaacaatgtgacgtcgacgggagccagcgtaagcaaggagggggctatcctgaccttcggcaaggagcatgtatccatctccctgcaaggggtgtttcccaactatacggagctggaggcggcaaagctgaaagaaggacgtttcatcaacgaccgcgacatgagggaacggcgcaaggtgctggtgctgcacgagaagacggtccgcatgctgtttcccaagacggaagcgctgggacagtacgtcgacgtgcagggagtagcttaccgggtagtgggtatctacgccgaccagaacagtttctcgccctcggcactcgtaccttttacgaccgtccagctggtatacggcaagggcgacagcatcgacaacctgacgtttgccaccgaagggctgaccgacgaggtgaccaaccagaagtttgaaacggattaccgcaaggcgatgggactgcacaagaacttcgaccccaccgaccaaagtgccatctggatgtggaaccgctttacacagtacctccagcagcagtcggctacccacattctgcacatcgccatctgggtaatcggcatattcaccctgctgagcggcatcgtgggcgtgagcaacatcatgctcatcaccgtgcgcgaacgtacgcacgagttcggcatccgcaaggcactgggagccaagcctgcctctatcctgtggctgattatctcggagagcgtggccatcaccactttcttcggctacatcggcatggtggcaggcatcgccgtcacggagtacatgaaccaggtaacgggcaagcagaccgtcgacgcgggcgtgttcagcgtaacggtcttcgagaatcctacggtagacctgagcatcgccgtccaggctaccctgacactgattatcgccggtacgcttgccggactcttccccgcccggaaggcagcccgcatccgtccgatagaagcattaagagcagactgacatgagaagaattgattttgacacgtgggaggaaatcttccttaccattacacgcaacaagacacgaagcgtgctgacggctttcggcatcttctggggaatcttcatgctggtggcactcatgggaggcgcacggggcatgcaggacatgctctcgcggcagtttcagggatttgccaccaactcgggattcatggcttccaacaatacgtcgaaggcttacaagggattccagcagggaagatggtggagtatggaaaatcaggacgtggaacgtctgcgcaacagcgtaccgggactggacatcgtgacggctaccatcgcccagtggggagtgaacatcgtatacgagcaatacagcatatcgggtacgctgaaaggactttatccggaatacgaccggatagaggaaccgctcatccgcatcggacgctcgctgaacgaaaccgacatacgcgaccgccggaaggtgtgcgtcatcgggaaacgtatctacgaaacgctcttcccaaagaaagacgacccctgcggcaagttcatcgagataaacggcatctactaccgggtagtgggagtgaacgaggcgacgggcaacatgtcggtcaacggacagtcggaaacgtcggtcgtcattccgttcagtaccatgcagcagaactataaccggggcaaccgcatcgacatgctgggatatacggcgaaaaaaggatattccatcagtcaggtggaaaaagatgtggaacgcatcgtgaaacaggcacacgccattcatcccgacgacgaacaggcggttatccgggtaaacgcggaagccatgttcagcatgatggacaacctgtttacgggtatccgtgttctgggatggctcgtgggactgggtacactgcttgccggtgccatcggggtgagcaacatcatgatgatcaccgtgaaggaacgtaccaccgaaatcggcatccgccgtgccatcggagcacgccccagcgacatcctgcaacagattctgctggaaagcatggtgcttaccaccctagcgggcatggcaggtatctcgtttgccgtcttcctgctcgatgccgtagaaaagggaacgtcggaaccgggactgccggcacacttcctcatcagcttctggcaagccatcggagcctgcgtcctgctcatcgtgctgggactgctggcgggactgattcctgcctaccgcgccatggcgataaaaccgatagaagccatacgcgacgaataatcaacctgacaatcgaaccattgaaataaaaacataaaaccatttatatgaagaaatttatcaaagttggcatattggtgctcatcgcactgatattcataggaaccttcgttttcctgtaccggaaatcacagccgaaagaggcccagtacaacatccagaaagtagaaacgaccgacctggtacagactaccgttgctacgggaaagattgaaccgcgcgacgaagtggaaatcaagccccagatttcgggtatcatctccgaagtatacaaggaggcgggacagaaagtgaagaagggggaagtgatagccaaggtaaaggtcatccccgaactgggacagctgaactctgccgagagtcgtgtccggctggcggaaatgaacggacggcaggcggaaaccgacctgacacgtatggagaagctctacaacgacaagctggtgagcaacgaagaatacgaaaagaccttgctggctgcccgtcaggcacgcgaggagattcaggctgcaaaggataacctggagattgtaaaggaaggtatcaccaagaacagtgcctcgttcagcagcacgctcatccgctctaccatcgacggactgatactcgacgtgcccatcaaggtgggtaactcggtcatcatgagcaacacgttcaacgacggtaccactatcgctaccgtagccgacatgagcgacctgattttccgtggcaacgtagacgaaaccgaagtgggacacatccgtgaagggattcccgtgaaaatcaccctgggtgccttgcagaacatgaagttcgatgccgtactggaatacatctcgcccaagagcgtggagaacaacggtgccaaccagtttgaaatcaaggcagccattaccgtacccgacagtgtgaccatccgttcgggctacagcgccaacgccgaaatggaactccagcgtgccaaccacgtgcttgccgttcccgaaagtgccctggaatttgtgggcgactcggctttcgtgtatgtgctgaccgacagcgtacctcgccagaaattcgaacgccgtgcagtcaagacaggcgtcagcgacggtatcaagatagaaatcaaacagggagtcggtgcaaacgactgtgtgcgcggacagaaaaaagacaactaatcctccggaaccatgaaactgaaacatattctctttatcgcttctgccactgccctgctgccggtacaggcacagcagaaatgggacttgcggcagtgtatcgaccacgccatcgccaacaacctgaacatcaagttgcaggaagcacagcgcgaccagaacaaggtggaagtaagtacggcacgaaacaatttcctgcccgacctgaacggtagtgcctcgcactcgttcaacttcggacgaagcctccagtcggataatacgtacaaaagtctgaatacccagaataccggtctgagcctgtcgaccagcatcccgctgttcaacggactgcaacgcatcaacagcgtggcactctcgaagctgaaccttcaggctgccatggaggacctgaacaaggcgaaagaagatatcagcatccaggtggcatcggcgtacctgcaagtactcttcaacgaagaactggtgaaggtggccaacgagcaactggcgctgagcaaggagatgctggaccagaaaacggctttctataagaacgggaaagcctcgcaagctgaatggtacgaagccaaggcacgcgtggcacaggatgagctttctgccgtacaagccgaaaacaaccgccgtcttgccctgctcgacctgagtcagctgctggagctcccctctcccgacgacttcggtatcgtatcgccggcagtcgattcgctcaccagcctgagcatacagacctctcccgccgaagtctatgccgaagcggtacttaccaagccggctatcaaagcagcacaatatcgtctggaaggtgccgacaagaacatccgcatcgccaagggagcctattacccgcagctcagcttcggggcaggcatcagcaccagtttctacaacgtgtcgggtatggagaacggcaacttcggctcacagctgcgcgacaacttcagccagtacatcggactctcgctcagcattcccatcttcgaccgcttcagcacccgcaaccgtgtacggagcgcacgcatccagcagcacacctactactggcaactggaggaaagcaagaaaaccctctacaaggagatacagcaagcctactacaacgccgtcaatgccgaaacacagtaccacagcagctgcaccgccgacgaagcggcacaggcttccttcctgctgatgaaggagaaatacgccaacggcaaggccaatgccaccgagtacaacgaatcgcgtacggcgtggatgaaagccgtgtccgaccgccttcaggccaaatacgactacctgttccgcaccaagatactcgacttctaccgcggcattccactcacgctgtaacatcccccgaaaccgacatacgtctatataaaaaagagccgcaggcgatactcaacgtacagcctgcggcattttagtctgtgttacgatttcggaaactcgatgtcgtgtctaaaaactatttatcgatgcattttataatagtcgatgcaatttttattgtctttctgcttttttatttgccgatacaaaaatgtgataatatgatgtagaatcggttactatcggacaaatccgctgccagattatttctgtccggcaatcagtgcggcagcctccaaaggttggttggtagtgatataatccactcccagcgttatcatcttctgcatgtccttcacattgtctacggtccagacattcaccttcatacccaagtcgtgcgcttccttcacccattccggatgtttcttaaaaaccttgtagtaataatcgatacccgtcagtcccttttccttcccctccttgggagcgatgtcaccattcaggtaagcgatttccgaacccggagtgaggcgtacaagctgttcgcacacgttcatgctgaacgagatatattccacctgtttctccagaccatattcctttaccatcttgacaaccgattcggcaatttggtattcctgagccttggtcttgtgaggcttgatttcgagaatcagctgcacaccgggcaacttctttcctgcctccagatagtcggccagcgtaggcaacgtctcgccgttcttcagtttcaggtctttcagcttgtcgtatgccgtttcgccgatagtcagcccgtctatcgcatcatcgtggttcaccactactaccccgtcggcagtgagctgtacatcaaattcagaaccatacaccttcgcctcggcagccttgttcagtgccgtgacagagttttgtgccgatccctccgctttccagaatccgcggtgggcaatcacctgtgtctgagcctgtgccgccagtgcaaggaacgcacaggcacaagccatcagtaagtttcttgttttcataatcatcgttatttattttcagtttgtttatcagaacgcctatctcaaacccgatctgaaccatcagcaatcctgacaacaccggcaggagcacccaaaaacagcgttcccaatctgatgcgacaaaagtaaaagccggatattacattcacataactgtgatgtaaagatagcgtgtaatttatatgaagaaactatttcaaattcaaacaaaacctatattctcccgttccggaatgtaccatgcggggaaaaccaaagcaaacatattaacctgccgtatctgtctatgtcagcgggaaagcaagtggtaaaagcagacaaagggctgcaaaaagctgcaaagaaataaatacggctgcatcaaaactccatttcaattaagacggactttatagctgaaccttgaaaacctgtaatgataaaaagaaagagccgtatcatcactcacacatagagcttgatacgactccttccaatcttattgtttcaacttatagccttccaaagcgtccacccctttcatgagaattcgctttcatcgattcgttagtccgtccggactttccagctacgatcaacgatcgtactgcggcatatccgggttgaagtcgagaacagtctgcggaaccggcatgatatagcgcgggtcgttggcaggcaatgtccaagtttcaccgttggcactgtgaacaatatccttgcggaaccagtcctcacggttcagacgtttcaagtcgatcagacgaggagctccctgcagggcaaactcacgacgacgttcgtcgatcaccaagcgcaatgcttccgtacgattaggagcatcggtagcctctacataatgtacattgttcttaatacgagcatcacgcaacttgtcgagcaactgcaatgcacggctgatagaaccgatacgtgcttcacattcggcagcaatcagataaatttccggagtcgtaaatccggcattctgattgatataaggagcatacgtactgtatcctttaaagtgttccggttccgaagaaggattcatggtaaagttagcctcgtcggtagcaaagaacagactcagacgcatatcttctccgtcaggagccagatgactcttgaatgtttcgagcaaatctttgctggcaacgacagcacggtagaaaccagaaccagctccacccaagttacgcataaagatattttctacattgcttacatcttccgggaaggtttcgtccggattggaagccaatacgatacgtccgaaggtgctgtatgtagtagtgtagggcttcatgtccagcaactggtcgttcagtttcagcgcttcgttggcattggtcagcgcattctcataatcgcccatgtagaggaacatacgtgcctgaaacgcataaccgatggtacggttaggatgatatacgttggtagctacttccggcaagagcggagtggcagtcttcaggtcagacataatctgattatacacttctgccaccgtattgcgcacgtacgaagctccgtcgcctacctcttcactcagcaggataggcactccgtaatcggtagcggctgtcgcagggtcatagtgattaccaaaaatattgaccagattcaggtattcgaatgcacggcccaccaaagcttcggcatattttgcctcccgctgttccttcgtaccgtcgggcacattcaggatgttgttggctactgcattgtatacataaatattagcataggcatcatcccacaaagggtcattgtttcccgcagtgagcacctgtcccgacttaaatgtatagaggttacgctcctggtcactgcatccggataaattgaattcagtgtactcaaccggatttccttccgaactaacattcatgatttctccatccgaagtacggtaaatatcatcggtcaagtaactgagcaccgtattcgatgaactcatcagataactgctgttcaacagtttagagtaatcctcgagcttctcggggatggtatatcctttcggcttgtttcctaaaaaatcatcacaactttgcaaggacaagataccaagtcctagcaagagatatttagacagattcatattatatcttaaattcatggttatacattaaaaatcgagtgccacaccaaatgtgtaagtagccggaatatgctgtcctctggatgtaggagtagccacttccggatcgaggttcttcttattggcagcccaatagaaggcgttctggatctgcaggctcagacgcaatccctgaatgtatgcgctacgcagccattgtttcgggaatgtgtagcccagtgtaatatcacgcaacttgatgtaatcgcctcgttcgatatgcttgtctgcatactgccacaaaccactacaagttttaccatttctgtactggaatgccggattcatgtccggatcgagttcatcacccggtttctgccagaatttcagacggtcgcggtccatgttgctggcatagttcagtaccggatacatagtaaactggtagctggatgctacgtcacgcattacgtttccaccatagtatacaaacatcatgctcaagtcgaagttcttgtaaccgaaacgagctgtaagtgatgaagagtaaggagcaatggttgttcctttgtaaaccaagtcttcagcctccagatcgtttaccgaattaatcacggtaccatcggctttgtaagcagtcgggttaccttcgctgtcgagtccggcatagcggatggcaaagatagagctcatcggataaccttcacggttctggtaagaaccatagtaactatatgcagaagttccggagtcgtcaatctgtgtcagcttgttcttgttgtagctgaacatgaagtcgatgccgaagctgaagtcacgggtacgtacaatctcactctgcaaagaaatttccacacctcagttcaccatcgcaccatagttcagcatcagtgaagtccatccgaaagtagaatcaaccagtcggttacccagcaaatcgctggttgccttgttataaaattccaagctaccgttcaagcggttgccgaacaagttgaaatcaactcccacgttcaccagtttggtcttttcccaacgcagcatcgggttaggagcacttaccacgtatgcctgatattcattggtatagtagtttgtaccgtcatcggctacaatcatgtacggacctgtatctttagccacgttaccgttgataccataagtcagacgtccagccagacgatccagcacacctttgttttccaagatgatatgctgcaaaccgacagaccacagaggcttgtactgatatttaggatcggtaccgaacaagttagactggtcgatacggatacttccggtcaaggtagtacggttgttgtaggtgtacgatgcatttccatagaacgacacgtaacggttatcatcgtatgtaaagccgtcggtacccagacggtaagtactgaagtagaagcttccgctggtagactgtgtaccacggataccctgtcccatggccagttcgtcgatagctttccaagaaagtgagttgtcatcgtaaccatatttatacaactgagtagtctgattaacgaccttacgacgttctgcaccggctatcacctgaatagagtgctttttcttgaaatcacggctgaagttgatctgcgcacgcaaggtatacgaatgatccttgccccagtactcgctcaagttaccaccttcaggaatgtaatgtgtagtggtaccgtcgctgttgagcaccgtagcgttgttgatcatagatgttacgctgtagtgattgatggagttatactgcttggtataactgttggtcatttcagtctgataacggacatcgaaagtcaaccctttgataatcttgaacgttgctcccaggttgatgttccaatactgctgtttatcctgatagtgtgcagtatttacgccgttgaccggatagaatgtttcatcgtacagtcccagtccgttcaaacggtcgatttcacgctgcgacttaccagtcatgtaccactgagccggagaaccatcctcattgcggatcatacggtatgacggaccactgtacagataactgtatcctgagaaaccgttatcataatcttgcgatacggtactgttcaagatacccaggtcgacatgcaaccatttgaagaaatcgaactggttcttgaagttgaaaccataacgattggtcttctgctccttggcatgcggcaagttctgctggaagttggcagaaagcgcatatttgtagatatccgaaccacccgagatagaaaggttatgctgatgagtggtattggaacgacgaacaaattcatccttgatctggtcgtaacggtcgcggttacggtatacatccaactgactttccagttcgctgtcgctcagctctccggcttcgttacgatacagcaagtcgtacacctcgttggtaaagctcgggctggtaggagcgtacgtgttatgaaaacagttgaacaataccttctgcaagtccaccagttccgcactcgacatcaggttcatgtaatcgcggtcgggcagcggttcaaacttgatactaccgttgtagcgaaccttcggcttaccctgttctccgctgcgggtagtgatgacgatgacaccattggcagactgagcaccgtagatagatgcagcagaagcatccttcaacacggttacattgacgatatcggatggattgatggcatccagactaccttcgtacggaataccgtcgactacataaagcggagtcttattggcattcaaggtagaaataccacgaatttcgggagtcgatccgttgaccttcataccggccaccataccttccatacggtcgaggatgttggtctggagcttatcctccatatctttctgattgacgatggagaacgatccggctgcacgttcttttgagatggtctgataaccggttacgattacctcgtctatcagttgagattccggctccagatcaaccgtatattgtttttttccactaacggtaatttcctgacttacataaccgatgaacgacactacaatggtttgtccctcgcgtacattgagcgagaatttaccattcacatcggttacagtaccattagacgttccttttactataacattggcccccacaaccggttcattgttctcatccaacacggttccttttatgtactgagaagcctgctgttctgtcagggcaacagagcccatcaccttttcgacctccgcctgcatcgggacagttccccaacaggcagccaaggccaaaaacaatccgtttttcagtgtttgtcttttgtttgttttcatactactatattattagtgcttcattttcggtttgggtttcaactcattggagcgcattgagtaagttttctttccgtattttggagcagaaagaatgcatgccggaacatgcgacttatcggtctggcggcgcaacacttcttccagtacggcagcataactctgatgtatcaaggcatcatcgcggtcgtattgattgtaagcgatatactgcaagtattccacacacttgttaaaccagaaatccggaattttatttatattatacggagtcaaccggcaaataaacttcaagcgttcgatgacctgctgctgattgacagtactgtcggcaatcatcgcatcaatccgtgcggcagcctcttcgtacttcttttctctcagctcatcatctatcagaatgaacgtgcggttgaacgacttaccttcaaaatcgcacaacgaatcaagagtagccacatcgccattcatcgtttccttacagagtttggcatctacctgatcttttccaaacagcttgcaatactgtgcatagttatcggatacttccttgatatacttgttgtccattcccgtaatagtacggcaatacagtttccagatatccggctcggtgagcttcgcacctcccgctatcagttcgtcgaacgctttctttacggcatccgtctgatagatagtcgcgttatactcaatgtaatctttcagcaactgtctgtctctgttgcctttctgatactcatcgtacaggtagaaagaacgacgggcaggcgtcagggcattctgaccggtagctataaattcctctgcagtctgccggctgctgctgaaatgaacagcctcgcacgtagcaggatcgacaaaaacatacgaaggatagaaacgtatcttgtatttcttcgcaagatcacgtccttcgccatgctcggcatcgattttcgcattgacaaaattctgattgtaaaattcaccgacttccggctgagtgaaaacattctgtgccatattcagacaggggccacaccactgtgtgtaaaaatcaatgaaaatcagtttattttcagccttagccttactaacaatttcagcccacgaaccgtggttaaattctataccaactgcccttgacttaaggggaatactgccaatacatatcagcagcaaaaatgcaaatgcatgttttaagttcataatagtatcttaaaagttcactataaatttaaattgattcataaattcatcccaatcctgccctagtctataaaacaggttccggatgaataaacaagcagtctaaagtctaatcaagggagtaggattgaatccaaaaaggaaaaggctctatttgaatgacttatcggagagcatatcttttttcacggcgcaaatatatagtattattttaatcaattttttatgcaaaaattccaaaataaaaaaataacatttttctaatataataagaaaataaacgacaaattgaagtacacaaacctacatttttaacacaaatcaaaccaaaagcgagacaaatgcgaaataaggtcataatcacccaagaattaaaaagactttacttttgaaaatattcaaacaacatctcataaaatacattaaaggaacaagcctattttcatacctaatctacctacaaagagcatcaaatgtgccctacaagctcccaaatcgagcatatctgccccgcgacaagtttaaagcaaaaggaaacatagaaacgacttgtctatacaattctttcttagccaccaaaagcatcccacaaaaccgtatatattccataaatacgagggacaagtgtgagagcgattactatttcatagatccattttcaaattcagaaacaaaaactttcccgtcaactaattttgcgtgaaaacggcaactccctttgagacccatatcgctgaaaaatacagtataccaatcatccccttctgtcgatatagatgttaccttagatttatcttctagaccatcctgcgcaccagtacgaaaaagccaaactgcgtagccgctaccatcatattcatattcatatgccttacgcaatttagtaagaatctcgggggaaaaatgttctacaacatcttcaaaatgaccaaccctatcgctccagaaaacgtatttgtcatatagctcttgtaaaaaagcattcacttgattctgttcattaacactcacggattccgtggtctcctccatagactttttgaatggtgtcttttgtaacaaaccgccacacgatgaaaagcctacataagcataaagaataaaaacactaaaaataattcttttcataacatcatttttcacaggaactctgcaaagccgttcggccgcttcttcctcaacctgacaaacaaaaagtagccgtattctctgctccggtaaagaatccggctacttttttattactatcagagaggataatccatcctccggcagttccttactttctttctgacaaggcttccggctccacgcaaccgattcacgctatgtacctgacgttcgcctaatttactaaaaatcagaaataagaaatggtacgcgtttctataaattctggttccgtcttggtagaaactctatccgcaccattttcagggtaatatgtagtaacctcccacgtacgctttaccctacgcttggtccagttaccttgactgtccgtttcaagataggtatagcggcatatctcaacatcgatgccatcttcataactggccgaagatttcattgtagaaggatatttaccggttccttcatacgtatatgtacgttccaccggcatcatcccatcaaaaaacttataccggacaacccgtccgcgactatcaaattcatattcaatggtaccctcaatacccttttcatccacttccttacgcaagttaccctcgcacgtaatccggaaaggacctatcacattatctatcatatagcgattcgctccttgataaatgtaccggtttgctccatcagacaccatattgccatttttgtcgaaggaaagagtcactttgccagtggtcaccgttcggacattcccatacaatccatgtccctgaacggacgtgaaagcagaagatgcaccagaaacattcaatgtaatttccggacagctcaaacgttgccttactctttggtcggcattcctgttgcctctgaaaaattcctccatcggatccatgaccttcgatccgtccgtctgccttatataagcatctacactaagatttccgatacgaagttttccctcatgcagaggataaagcaacagttgtctaaatacaatcgtctggtattctttcccgttccgggtttccaatttccatttcttttcccgaaggcttgccggtttcaccttgaaatccttaagcaaaatctgttgttgaagatttgccagactatccacctgtgcggtagtatacagtttacactccaacaccacaggactgtttacgcgaggagaacgattggatacattcatcgttatgaaagtttccgacttcggctccacacttacgccggaagaagaaggtagtttcccctcaggtaccacatggatagtaagctgctgtgtacgcaataactttccctttacgacaagactggtagaaggaatcacaaactctccggtttcgaatgccttcagtacgtaagtataagagtactgataggttggcatagttacttttccggtagtagccgtacttcgtaccggacccatcaaaacctcaaagtctctcaacggaggttccctaaaatactgtatctcatcgctttgaagcttttccgatgaaatgacagccagtgtcaaccggaactgtgaaccaaactccacatactctggtgcagaggctacaaacacgggattctgataagcccatacctcctttggtaaaaggaacaacactaaaaagaatagcttaaaatatagaaatgttttcattttatcatctgattttaaattcgctggaatgattctcctgtttttttgtaaatatgtccatcatttccatcataaatatccccattgttgtacgtcagtcttgtagtgataccttccggattgataatcgtatagtcaccatccgcagtcagcgtaccatgcggattggggtatccgtctttatcggacaatacgcctccaggcgccatgttgattttcaatgcaatggccaatacgatagcgataatcactaaaataatgagtacaaacaccagacaagatgctaaaatgacaatggaaacagaacccaatatatatagcaaactggctgccaatgctgccaagaaacgtttcttggcaatcagctggatcaagatgatgcaaacctgaataacctgacaaacgcctataatcagataaatatagatagggtcgtaacctccaattccacaaataaccaatgcgataattcccgccagccaagtatacaatcccaacatcagattgacagaagtgtgcgctgtatttgctatatccttcatggtcatgaggaagaatacaagcaagttgataagcacataaatgaaaaaaataaaattcaagatgacaaaccaccacgagtgtacaatggaaggcataaagaaccataaggaattacttcccatctgcatgacatagaaaaggattgtacctgaagtaatcgccagcaaaatcccgtttatccaagcccatcgggtatctccactaccatttgcagcccgaatattaagggtaagatgacgtatgaatttacattcaaaccacatcagcaaggccagtccgcaaatcagataaaccatccaacggtatccatctccttcccagtccagaagcttgtaccaccgttttgcctgagcagcaggagcttgctccgacatggtactttctgctgccgtcaggtatttggcttgcaagtatccactcgtaccattatagtctacacgtacccagtctgatttttcagaaattgtacttaaatcagccgaacactctactatatctccattattcagctttaaaagtatggccgatgctgttgaaggttcacttcttaaatttaaggtagaactcacattcactttatatgggtatccccagaaaggcaaggatacaactaaagctatcaggataaaaaataatcttttcatacaattcagtcttcgtaagagaaatcaaaaggaaggaaaaaagtaataacaaaaagcaaggccataaatccgattttgagaatccatttgataagcaaaatgaacaaaataagccagatgacagcaaatatcagcatagcaataggatgatcggacatccattctgatgccgacagaggcaaaacgaaaagtgtttccatagcaaacaaatggccttccagtttctttccagcctttaataaaaacatgaggcgtgaaactgcaatgctatattctcgtttcagaccaaagaatgtttaagtctgcattctttacacgacaagcatatcgccccctaaaaaacattcaagaaaaataattacaaatataatgtatttcatttattatttacaacaattagaggggtaaaataaaaattcctgtccacattctccccaaaatcatcaaaacgtcttagggaaaacgtgggcaggaattcttgttttctgtacaaaaaataaaaccttttatatagtatgtgacaggcggtttcagagtgaaataccgcgtttcagctcgtcttctaccaccgccatcatgccctctacctgagccagcgccaacatgcggccgtggaacgagtaaccgggattataacccttgtcctcgtcgcccagcatcatgcgaccgtggtccacacgcatggggagtcccggacgctcctgctcgaagatacggatcaggtcgatgagatgaccgcgtcccgacaggtgcgaactctcgatgaagttgcctcccggcatggcagccgtactgcgcaggtgtacaaagtgggtacgcttggcgaacttccttgccagctcgcgcgtatcgttgtgcacgcctgcactaagcgaacccgcacagaacgtcagaccgttatgcggattgtctaccgcatggaggaaccagtcgatatcttcctcgttggtcacgatacgcggcagtcccaatatctggaaaggagggtcgtcgggatgcacgcacatgttcacgccgtactcctcgcacaccggcatcaccgccgagaggaaataacgcatgttctcgcgcagcgcatcgcggtcgatgccgtcgtacagcgaaagcagacgcttgaagatagccaccggctgcttgtcgccctcacggatattgccgttcacgaagccctgcgtcttcacgatgattgcgtccaccagctcatccttttccgcctcggtaatcaccttgtccagctctgccaccttgcacagctcctcctccgtgtagtccttctcggcacccgcgcgttgcaggatacgcgtatcgaaataagcaaagcgcacccggtcgtagtacagcgagctgctgccgtccgcccacggatgatgcaagtcggtacgcacccagtctatcaccggcatgaagttgtagcacacggtctttacgccgcacttgcccagattggcaaggctcaccttgtaattttcaatcagctgatcgcgttccggtcccgcatacttgatagcctcgcacaccggaaggctctctaccaccgaccatcgcatgccgtacgactcgatgtactgcttcaggtcgtttattgcctctaccgtccagatttctccgttcggcacctcgtgaagggcggttacgatgccctccacccctatctgtcggagcatggaaagtgtgatcttgtctttctttccaaaccatctccatgttttttccatcataatgctctgtatgttttataccccactaaaagcgctgaatccaccatccacagccagaacagctccggtaatgaaacttgccgcatcgctgcacaggaactgcactgctccgttcagctcggagatgtcgccaaaacgtttcatcggcgtcttggcaatcaccttccgactgcgttccgtcagcgagccgtcggggttgagaaggatggcacggttctggttgccgatgaagaatcccggcgcaatggcattcacacggatcttttcgctgaacttaatcgccatttcctgcgccatccagcgggtgaagttctctaccgcactcttcgccatggagtagcccggcacacgcgtaatcgactcgtaggctgccatcgacgatacgttgacgatgactccgtactgctggcgtgccatgatttcgccgaataccagacaaggatataccgtaccgttcaggttcaggtcgaccaccttgtcgaggtcttccaccttcatgtcgaaaatgttctggtcgacggtgagcgtacctccggggatgtttcctccggctgcgttgaccagaatgtcaatgcgtccccactgcgaaagtacctgatccttcacggcttgcaggctgcggatgtcgagcacgttgcacaccgtacccgctacctcactgctcaccgcacgaaggcgttccagtgccgcatccacacgctcctgatgcgctcctatgataatgactctggctcctgcacgcaggaaaccttcggcgatgttgctgcccaatacaccggatccgcccgtaacgacggctacctttccggcgatgctaaactgttcgttcataagctgaattgtttttcgattgtctgctgcaaaaatagcgtgaatttgcagaccgaataatgcgtatttttgcaagagttttgcgtatttttgcagacaaccttttctctgccgtcatgaaaaagattctgaacgaacgcattgccatctccagctcgaacccgatacgggcgcgcttctacgattaccgcggatttacgtatccgtggcacttccacagcgaatacgaactgatgttcgtggaacaggggtacggcaagtgtctggtgggcgacagcattatcgactaccgggcaggcgacctgattttcttcgggtcgggactgccgcactgcatgcagaactgtcccgaggcggaggagaacgaggcgtatcacgtgtgcggggtgaacatccagctggagaaggacttcatgcagtattcgttttcgcactacacgcagtttgcctccatccgttcgctgctggagaaggcacaccgcggcatccgtttcccgcttgccggaagaagcgagatagccgagtgcctgaagcgtattcccgtagcgcacggggtggaacagatgatcgagattctgaagctgctgcaaactctctcggctttcccgcgcaagcagtttgctgcctcgcccaactacctccccgacccgtcggtatttggcgacaagaagatagagaaaatcatcgcctacctgaacaagcgttacacacagcccgtcagcctgagtgagattgcatcgtataccgccatgaacgaggcggctttctgccggtatttcaagcaggaaacgggcaagacgttcaagcagtacatcctcgacatgcgcatcggctatgcctgcaagctgctcgcagccggacggatgaacgtgtcgcagatcagtctggagtgcggattcgagtcgacggcgcacttcaaccgtatcttcaagcggctcacgggcatggctcctacttcataccgtgagagtattttataaaccaactttcgcataaacacgctgaagctcataaaccggatgcaaaatcactatgaacagcttgtaagccaatcttgcatagatgctgaagctcataaacaaggcattcaagatttgtgggctaaaaatgcaggttcccatagacacgccgaagctgatagccggatgcaagaattactatgaacatcttgtaaacaaaatcccgcatagatgctgaagttcataaaccgattgcaagaaccgccgtgagcatcttgtaaacaaaccttacgtaagcgttaaaccctcttaaaaagcgaggcctataaggtcacaagttattcatcaattttctacctttgccgccagaaataacaacaaggacatcacaaaaatcatgaaaacaatcattcttgtcaatacggttcgctacatcaacaaaatccacgatttccatacgtggggagctgctgcattgatttgattttacccttctacatgtcttttcccgttgtttatatccattcagtaaaaatctaataaacattttatttgtatgagcaaaacaagcaggctcatagtgctgtgtagtgcagtactatgcagccagtatctgtgtgcccagtcgcgtacgatgggcatagaagagatgttccgtctggccgacgagaacagcaagagtatccagacttaccgtaccggaaaggaagttgccgacgagaacctgaaagctgccaaggcacagcggttgcccgacatcagtgcgtcactctcgggcagctactggggcaacggcaagctgtgggatcgtgatttcagcaatgccaccaagatagacatgccgcactggggcaacaacttcgccctcgaggctcagcaggtggtgtatgccggaggtgccatcagcagcggtatcgagctggcggagctggagaagcaactggcggagatggactggcagaagaatcgtcaggatatccgcttcctgctcgtgggacattacctgaatctgtataagctgcataaccagatcgaggtgctgcacaagaatctggagctgaccgaccagttgattgccaacatgcaggcgcgactggaagagggtacggcgctggagaacgacatcacgcgctacgagctgcaacgggaaacgctccgtctgcaactggccaaggtggaggatgcctgcaagatagccaatcatcagctggtcatcaccctgcacttgcccgaagggacggtggttcagcccgatacaacgctgaacgacagtcagattcagacgatgagtgaagccaactggcaggagttggcggcgcagaacaacctcaacttgcagcaggcggaaacgggcatcaaggtcaaccgccagcgggtgaagatggaacgttcggagcggttgccgaaaatctcgctcgtggcagccgaacatctggacggaccgatcaccatcgaggtgcctgtgctcgacaataatttcaattactggtatgtgggtgtgggcgtgaagtacaatatctcgtcactcttcaagaacaaccggaagctgaaggcggctcgcctcaacgtacggaaggctcaggaaacgtacgagctggcacaggagcagaccaatcatgcggtgcaggagagttacgtgaatttcctcacgtcgtttaccgacttgcgcacgcagcagaagagcgtggagcttgccgaccagaactacagcgtgacgagcaaccgttaccagaacgatctggcgctgctgacggatatgctggatgccagtaacatgaagctcagtgctgacctggggctggtgaacgctcgtatcaacgtgatttacaattattataagatgaaatatattactcatacgttgtaattctcacacctgctgcaaagttcctacacgatgcaaggctttacacccgctgtaagttttacactcgctgcaaagttcctgctcgatgcaaggctttacacctgctgtaagttttacactcgctgcaaagttcctgctcgatgcaaggcttcacacctgctgtaagttttacactcgctacaaagtttctgcacgatgcaaaggcttacacccattatcaaacattacagattgacagagagagattacagcagcgattgaaaatcatcccatttatacattatactacactttataacaaacctaccattatggctacaagaaaagttcaaaaactcatttacaataccgttatcatctgcctgctggcagtggcacttatctatgtgtgttcacgcttctttcatccgggcgtggaatataccgacaatgctcaggtgaaacagcatatcacgcccgtgaatacgcgtgtgcagggattcatcaagcagatttgtttcgaagagtatcagccggtacacaagggcgatacgctggtcatcatcgaggacagcgagttcaagctgcgactggctcaggcggaggccgatcttgccaacgcgctgtcgggtcagcaggctaccagcatgggcatcgctaccacacagaacaacctgcgggtgaacgatgcgggtatcgaggaggcacgtgtgcagatggagaatgccaagcgcgactacgagcgttaccagaagctgttgcagcagaaggcagtcacccgtcagcagttcgataatgtaaaaacagcgtacgaagccagcaaggctcgctacgatcaggtgcgccgtgccaagcattctacctcgctgaccaagagtgaacaaacccaccgactgggacagaacgaggctggggttcgtctggcacaggctgccgtcgaactggctcagctgaacttaggctatacggtcatcgtggctacctgcgacggtgtgacgggacggaaagacatccacgaaggtcagctggtacagccgggacagaccatggtggacatcgtagacagcagcgatctgtgggtgattgccaactatcgtgaaacgcagcttcccaacatcaaggagggctacgaggtaacgcttaccgccgatgccgtgccgggtgtgacttacacaggtgtggtggaatcgatctccgacgctaccggagcggctttctccctcatcccgcaggacaatgctacgggtaacttcgtgaaggtggaacagcgtgtgccggtgcgcatcagcctgaagggaaacagtgccgacaagctgaaactgctgcgtgccggattcaatgtggaatgtaaagtgaaatactgatatgggagcacctgtactgaacggaccgtttacgatgccgatgttccgtaacttcgtgcctcgtaagctgcaaccgtggctttatatctttctggccgtcagcttccagctctcgggcgggctgtacatggccaacctgagtcacatggtgagcgaaacgtcgctcatgcacgaggatctccagatgtgtctgtactgcaacctggcggggatggcggtgtacttccccatcctcttccgcatgaagttccgctttaccaacaagacgctgctcacggcggcttcgctggggggtatcgtgtgcaacctcatcacgccgtacaccacctttctgccgctactctggacgctctgcttcatcgaggggatctgcaagattcagggtaccttcgaggcgatgtcgaccatccagctgtggatgacgcccaagcgtaactttaccgtgttttttccgatgctgcacatcatcatcttaggcagcatgcaggtatcgagcatccttgccacttacttcggctattacctgcactggagctacatgcactggttcatggcgggactgatgctggtggatctgctcatcgtgcagggctgtacgcggcatttccgcatcgtcaagaagttcccgctgttcggtgtcgactggctgggagcgattctctgggcactcctgctgctggaaatcgcctatttcttcgactacggtgagttttacgactggtggaacagtccggtgatgcagggacttgccgttgtcatcgtcataaccttaggattctgcgtgggacgaatgctgcacatccatcatccttacatcgaaccggagatgtggggctaccgtcgcctgctgcccatcctcatcctcattacgctggtggaagcctttcttgccaccgagcatgtgctggagggcgtattccacagcagcgtgatgcactacgaagagatggtggccatgcagctcgactggcccatgctggtgggcgtcgtagcgggaagcctcttcgcctactggtggatgcacgtccgtcagctcagttacttgcgcctcatcaccgtaggcatcgcctcgcttgcatgctacctgctcacgttctacttcgtcctctccgccgacatccatatctcgcagctcttcctgcctacgctgtgccgcggatttgcctacgccatcctgagtgctaccttcatggtgtgtctggaagagatcatgaccttccgccacttctttcaggcgctgagcgtattcaacatgctgcacatggtggtgggtggtgtcatgggaggtgccctgtacggtcgctggctgtcgtactacgtatccgacaacatggcacgctacggagccgctgtcgaccgcgtggcattcagcagtcagccatttgccctcgaccgcttcatcgagcaattcgtgtcgcagatgatggaagtgagcatccgtcagatttacggctggaccctctacgcctgcgtcttcctgctgttgctcttcctgctctacgatgcgcccgtacgccgtgagctgaagctcatgccgagctggagaagcctgcgcaaggaggctgcacagatgttcagcaagggtaaaccgaaaggaaacgctgttcctccaaaggaagaagcttaaacgattttaggtttaagaagttcaatcaaactcaaaggaaacgctgtccctccaaaggaagaagcttaaacggatttgagtttgggaagctcctcggttgaaattcctgtataaaaggctgtttcaaaataaaaaacagagataagcttgcctataagctataaattacaacataaaaatctcctacgtcagtctttgttttcttctattacaagactaaaagtaggagatttttcattcctaaacctcaatctgtcaagtccttacttttgcaattctattttgatacagcctcttggtagatttcatcaagatcactttttatttgtgtacgacaagcatatataaccatccaattatcagcactgcatttatgtacaagtccttttgcccaaatgaatgcacataccgttttacagcagcgtattacagcagtcagaagatgtttatcgcacagcataatacccccaactgtccgggcaaaaaaacagaggctacccctatcactaggaatagccccccaagaataatttttaagagagaaaaaataacctttattccaaaggtttacttatttccaaattttcatagtattccaaatatcctgctaccgaagaacccgcaaatgcgtatatcatcggataatctactgccgctccgtcggtataggcactgcaatgtccaaagtgataaaccagtcttccatcctttaccttaggcacagctacacacggcacagacagtgagtaatatccgccgctcagggctgtagctgttttcagcgtataaccgctaaaactacctactgttacgtttgccggaacactcaagtttccattttcaccgacttccagcggtaaatagttttcctgcagagcatctatgataaccagattgcccgaaagcataccaacctgaccggttcccacgatttcctgttcatgcgccccactaatataagacatatcccagtagcctccaatcatatcagccgatacttcaatctgagaaaggctgagtaccagttcctttgcacctgccgagagcttgacttccgcaccgcgtggagtcttgtcggccgatgcagctacattaaacttcaacacattgttttctgtatcgtacgtataagtcagccatccggcagcctcttccggcacctccacactataagaggtattggtcttgaagctgaaatcaaactctccgccatcgtatccgcagcagtaatacaagttataatcatccagaatggtgaccgctcccgcctgtatcacaggcacatctacagagttcgtacccgccgaaatggtaaccacggcaatacggctggtcacctccgaagaggtggttacagccacatgtaccacattgccttccacagtcgttgtacaccattccttattcgaagcagcggttacagcctctgtagcactcacggtaatagtcccttctccactggcagcagagaaatcaatgccgtcggtcgcaacgacctgcaatgagcttgttacagcttcctcatcgctacatgccaccaacaaggtgcataagcataacgttataatagaaaatatctttttcataatcaatccttattttaatcagaaactttagtgaataccggattttcccaagcagtcatcattgtatatccacccgaattatagatgaacaaccagtcatttccatctgaaccatacggactattttcgaatgtaatcgtcatctgaccatcctgttcagtagttgttccttcaaagacagtttccagtgtagaatagaagcgaccttccgctctgattcccggatacaagcctacagctgcaccatccatatatcctaccacctgaccgttggcagagatatcgtcacgttctgcatcgtagtagaattcgattgtcatcgaccatgtaccgccactattcaagttataaactttcgtagcctgataagacttaccgtctttcttcttttccagtgtcaggctgaagctggagcttccactctgtacccgatacgtacccagatacttttcataattggcaggacgttcgaataccagctttacattgcttccctcatcggtacaggtaaacgtactggttgcattatcccacgtaaagttctgcatcgatatgccattacaaaccattggttccaccgttctcacaccagtctccgtgcagacgaacgggaaataagcataagagggagtgccattctcgtctacactctccagcaggaatgcacgatcttctctcatgaccgaagctaccttctggtcaccctgcatcaaactaaacagattgtagtctgaatcttcgctgatctgtgcggcagcagccagataagtagtccagtccaccgtatcgtccaaccgtgtcatcaccatttccacgccatacttcttgccggcgaggcgaatctcgttctcactcatggaacgcacgatgaattcataatcgcccatcaagcccggatcgttatagccgttgggttcacagaactcatgcagaatctcgttgtacgagtcgaagctgatttccgttccgttatacgactgtacggtatagagcgaagtagcagtctgtccggggctatacgaagaagtcgcataatcggaagcaatcgtcacctcgttggcatcaaacttaaagaacaggttggcagctccacccagacctccactgccataacgatattccagcttccacccgtttgtagaactggtcaacaaactcttcaattcaaggaccgaagcattttccctgtcggcagacgactgttcgaacaaatcctcctcgctgaacaagcacgactgcatggaaaacgtcatacatgccaataaactatataaaattaatttcttcataattccagtgttttattagttgaacaaggtattgatttctccctgccgacgctgaaccacgtcacgcaattcataaaggtctactccccatgaatctttcatgtacttgtacacaatgtcgaacttctgttccaggatagcccgtccgtcaacacctgccttgtaataggggctgttcggattcggttcggcagcttccagatacgattcccatgtgtctgccgtgttggtcacaaagatagacagcatttcggcaaagtcctccgagccacggtccatggcatacggagagataaatcccatctgcaacgcctgttcatcgtaaatatgataccagtcggaacccacatagctcgattcggtgatacggtcgtagttcgtatcgtaaggcttacgctggttcaggatgtgcgtaaactcgtggtgcatggtcttgaagtaatactcattcagggtagctacatccaggttgttcacgtcgaggtcgtttatcttgaagagtgtcaccttcataccctgttctgcctgacccagaatcatacccgattccgtataagccacgttaccgatcatctggatcagcttcggtacataggtacgtgtggtttcaatgccccatacctcgtcgtaagcttccatccatacaaacttcacgatcttagccagtgcgaaagccttctcataatcggcaggcaccagatcgtattccacgtccgtttcattatcatccagacgatattttacctgaatgttatacgtatagacatagttttcaagcagccatttgtcgaattcgttcggttcctcggcctccgttccgtccgatccgaatatactgtgcgaggtatctatctcatcttcgttgttacaagaaacaaatcccagcgacagtaaaaacattgatgcgtatataaagtattttttcataattgttcctccttaccgattagttatttcttggattaggcttcatgcctgcgctgattacatcgctcggaatctgaatggcacgacgatcgtcattggcatccatctggtcggttacctcgatgctgccgtcatccttcatgtaacggcgatataccgtgataccgaaacgtttgatatccagccagcggagtccttcgtacaaggtagtgatacggcgagcctgcaggatagcgtgaatcatattttcctgtgtacccttctcgatggtaaattccggatgcagctccttcttcaccgtcggtgaggtcggcgtataataagccagtccgtcgtagaaagtattgatttcatcttccgtcatcgcctgcgaacgggtagtataggcagccatccagctgttcaggtcggccagtgcatgcgtataatccttcttcatggcataagcctcggcacggctcagcagcagctcgtcggtagtaaacgctgcattcacacaataaccgttgatggttccggctaccacatccacatattccttgtactgtgccaccttcatcgaaataatcttggtaggcagtgccgaagagttactccatacgcccacgtgataaatcgtcgtattcgggctggaagtataattaccccacggaccgttcgagcggtttgtttcgtacgaaaccaccggaccgtgtgcatagcgttctcccagtccgtaagggccgctcacgtatccccagtaagaatggaagcaaaccagcatcaggttggccgatctttccgcatccacatattcgttcggctggatttcaccgttcagcgacaaagctcccagtgcctcccagtcacgcaacatcatcgaaggattgtctcccagtacggcattggcatacgttatcaccttgtcgtagttcgacagatccggctgtgtatagttcaggtagaaacgtgccgcaaaggcattcgccgcattcttggtgaaatgatacttgggcaccgaatacttgctgtcgcttatcagcggaagtccctccagcaagtccttctcaatacctttatatacatcctccagcgtaccgcgttcgtagctcgggctcacggtattttccagcgaagtcatgtaaggtatacccagatcggtagacgctgtcgacgaataagccttgcagaataccgtagccaggataaagtgattgtacgcacggcacatcagcgcttctccacgggtagcatccatcgtcgagggattaccctgctcggcaatcatcgccaatacctcattggcagtagcaatcgccttgtagcatccttcccacacggcagccggagaatcgtccgcgttctgagaagtatcttcccacttgtacaagtcctcctgcagacggtccatagccgcataacggttagggtaagcatcggtattatcactatacatttcaaacatttccagaggcatgctattaggataagccgtcaccagcagataatctgcgttttccggagtcacttccgtacgctggtctggcatctcatccaaaaaatcactacaggaagacaatcctatcgaacttcctacaatggctgctaataatatatatttcttgttcataatgtcctattttttgttataagcctaatctcagtgtaaatgtaaactgacgtggaaccggagaagccacaccacctgcattgaagaattcaggatcctgtccgttcaacttcttgtcagcataaagcaggaacaagttcgttgcctgtaccttcagcgagaggttcgacagcttcagcggagcgatccatgctttcgggaactcgtatgccagtgaaatttccttcatacggatgaagtcaccctttgccacacgtacatccgagtagttgtaagcattgtacgcatatttgtaatcggtattttcgttgtacattctggcagagatgatagcaggaatgttggttacattctcatcacccggcaaagtccagcggttcttgaactcacgagtcatggcgctcaggtcggaatactgtgcactgaataccggattcagacgaaccacgttgccaaacgaataagtcataaagatattcaggcggaaacctttgtacgtaaagatgttacccaaactaccggtaatggtcggatcggtaggaccttcgtaaatcaggaagtccgtgttgtcacgttcctggaagttgatgctggtactggttatctcacccttttcgttttcaatcaaaggaataccgttttcatccagtcccttgaacgggatagagaacaaacctcttaccggatagccctgcttagcgaaacctgtacccgaaatcagatccatgatattggaattctgctgcaggtcggttaccgtgttctgtgcattcgagaagatgaagtccgtattccagttaaagtcttttgtcttgatgttatgagtagacaaggtaaattccacaccgtgcgacttcatcgaagctacgttggcaagtttcaggatcgtaccacctacaccctgcgtattcaccgcaccaatcaagtcgtagttgttacgcgtataccagtcgagtgcaaagttgatacggttgtcgaggaatcccatatccacaccgatgttcaactcatgtttcttttcgtaagtcagctcactgttttccagatccaccagttgcaagcccgattcctgaatgttggtaaacggacggtaaggaatgtaactgttgatgatcgccttcgagttggttacatccgccggaccacggtcggcagtcagagagtaagaagccttcagtgtcaagtgcgacatggcaggttccagcgcgtcgaagaacttctcttcatgcacgttccatgcacccgagatgttccatgtaggcaaccagcgtgcgctacggctcttacccatacggttcgtaccttcgtaacggatcgtaccgttgattgaatattttccggcatacgaatagttggcattggcaaagaaagccacgctgcgcaccttcgtattgttcaggctgaagtactggtcgccgtcttcaatgcctttcttgaaatactgataaatatagtaaggcgtttcaccgttttcatactgcataccccagccctggaagttcgactttgtacggtcgatggagttcacttccataccaccgaaccagttggtcagatgtacctcgttgaacaccttgttatagttcaccgtaccacggaagtcgtagctcagcatcttgtagtcggtacgtctgtaaataccaccttccggcaaaaccgagataggcaatgcatacggattgtccgggtcggtatacaagaacgggttcttgtccatgattgtcttgtcatccagtccggcgcggtaagcctccgcctggttcgaattatccttaatcttgtgttcctgtgcagtaccctgatactttacagcacccagcgcactgaattccagtcccgcaatcggtttccatttcagttcaccctgaaacttcacatccacaatgttcaagtccatatagttgttttccagctcgttcaagatattaaacggagcatagttgctggtataatactcattcgggtcgagcgtacgtgaagtattcagcgcgtaagagtacgggttgatatcgaaatcacgcttcacctcaccggaaaccacatccacatcctgtcccagtgtacccggagcctcctgattacggtaagaggcgttggcaatcatgttaaagctcaaccatttcgaaatgttgtaagaagaattcacatttgccgtataacgttctaccgagctgcgcttgtaccatcccggatcgtacatggcactcagagaagcatagaacgacgacttgtccgtaccgctgctgagacttaccgaatggttctggctcagacttggtgagaaaagaacatcaaaccagtcggtattgcggaattcggcagcctgcaagtaactgttgcgagcgctttccgtattctgcaacatcggcagccccgtattcggatcaaacgtattcatcagctgatacatcttgccgtatacaccactttcggcagcacgtacggtttccgagaagttcagccaccccttctgctccatctgtttatagatacccatctgttcctgagagttcatgatgttgaaatcattgtaactcggcaccagacgtgtggtaaactcacctgtataatttactctactggaaccagccttaccttttttggttgtaacgacgattacacctgccatggcgcgcgcaccgtagatagaagtcgcagaaccatccttcaagatttggaagctctcgatatcgtcggcattcaatcctgcaatggcagaactgatcaacgtctcggcgtcacccgaagaaagctggtcggcacttacttctaccgcatcttccatgatcactccatccacaacccacaacggcttggaactaccgtagatggatgtagcaccacgtacacggattttcggagctgtaccgaaagtaccggaaacgttctgtaccgatacaccggcagccttaccttccagaccacggctgatatcggcaagaccatccatcttcacgttctcaccggaaatctgagtggcagcaccactgaacagtcgcttatccatgcgctgcataccggttacgactacttcatccagcacttccgtatccgattccagcaccaccttcatattatttttggccgtcaccgtctgcgatttcataccgatataactaatctcgagctttgcccctttgtctactttcagcgtaaactttccgtcgatatccgtaattgtaccgttagaagttccttttactaaaacagaagctcccacaacaggcatgttatcttccgaagaaactatcaagcctgtcacttgtacagcctgagctatcgccagacttatgccaattaacaaaaaggcacaaaaaagtgtaattcgctttttcatattccaatatttttttgataacgttggcaaatatatatagcattttattaaaaaacaaaaaataatagaaaaagtaataaataagcttgcatatgtcacatcaatatcaaatagacactaaaaagaacgaattacaccacgaataaagctattttcataacaaaaactttataaatataggatttcataaattcaatagacaaatttatgtatacacaaacgctaataaacattaaaaataaaggggctcactacaagaacccctttacttaaaacactaatctacaaacacttatgtaatagttaaattttgataaaaatcacatatattttatttctaacactttgataagacagaaacacaaaaactttacataaagatattttacttcttacattttacagttccgtagccacatcaaagcacggacacattttggtccactcttccggttccacaatcccgtcgccatccaggtcggggctcaggtcgcggtgccccacgatacgccgtgtctggaagtccatggcaagtaccctgaccagcacccttagcgcccgcttctgaagctccgtccgcgtatcagcaggccgtccctgttcgtccagccctccttcgtagcacaccccgatgctgttgcggttgaaccccttggcatgagccccctcctgctgcaccggacgcatggtacaaatctttccatcgcgtctcacatagaaatgatacccgcagcacttgaagccccgctgccggtgcatctgttccagctgttcgggcgagagcggcttgtctgccctcgtagccgaacaatgaaccacaatcaagtcaatttttctcactgcttcccccctttcttcctgtgagcaagcagtacaggcacttcagaattccgagtaaaatccatttcacctttccagtcataccttcccctcctcattgttatttgttttacctgcttccggatcatagtttattcctcttttttcggcttcaccgccacacgctcgtagctcagcgaagtgaggatatccgtcagatcagctcccggacggaaattgatgtgcgccttcttgatgagtcctgcatggaaatcctcttccacgtcagccccctcgctcttcagtccgatctgaaacgaacccaagtcgcccagacgcacgatctctccgcctgccagtccctcacgcatcaccgtaccgagcgaaaccagtaccgccatggtatcggcacgtgtcaccgtacacatctgctggatacgttccgtcatctcacggattcccatttcgccgcgcgcctgcgcctgcgcataaaacttggcttccccttccatgtcgttgggtttctttcttgccactaccgaataagtcactgctctttccataatctttttacctttttaaatgattaataaaacgaatacctgttgaaagctttcaaacttcttttctgtatcacaaagatatacagcccggttttggtaatgtccgtcaccgtccgtcatgcggacacattgttacaataaacaaaaaaaacaggctgtaccggccttgcaccccgacggacaaccgcctgcgcaagcctgtacagccagtcagctgaaaagaaaaggaagccggacgaagagcatccggccgccggacctgtcagttggcccggctcaattttatgttatcgataaaccagcggcgatagacactgctgcccgaagtagcagccgtttcaccccacgcatccgacttgatggtgatgcgtgtatccttcgtgatggaaacaccctccagcaccacgtcggcatgcagccattccagcttatccaccgtgttcacgaagttatgtcctatcggattcatttccaccgtcttgctgccgtttgtcaccgtaatgatcagctgtaccgggtcgaacttccgcgtaccgcccaccatcggagcccagtcgaacgaaagcattaccttctcgccttccggaataccgtctaccggcggcaatgtcaagcccgcctgataatccgtcttaccgaacttcaggtaacacttctgcaagtagatagaagcaccgcgactctcttccagtccgtatccgtgagccagcaacgcctcagccgctgtctgtccctcgtcgttcttggcactgtaaatctgcggagcatcccccgtaccgtcgttttccaccgtctgtccggcaccgctgttctcggcccacggcaagagccattcaaagtcgtcggcaaagtagatcacctctactacccctttgtcttcgatgcgtgccgcccgtatgcgcagtgcaggagcagccactccgtcgaagtaaccgtataccgtcacccgatgtccgttcagggcagacaagttcaggctctcgggcgcgtcgatgatggaaaccgagtttaccgccccgtcgatggtgatattgctgccgttcatcacaccgcttgccgaaatccattcgcggctgtccgatgtatagctgtccacctctgccgtcacgtcgtgcgcttccggataatccacgttattgccttccgaaaccacacgcgcctcgtcgcatgccacgtaaggcagcgagtgcgtatccgtattctttgtacccttcacggccaccttgtcgcccacgtttaccgcagtcgttgtctgcaagaacatgttcaccgcatggtcagcatcggttaccacgcagcccgatgtcgttaccgccgtaaccagcgcttccggtaccgataccaccgtttcatcctccagagccggcagctcgtctaccgtatactcctgacagtcgcgatacttgtcgccttcctgcgacaccaccacttccgcacgacttgccagcgtacaacccttgaacacgattgtcgccttacgcggattatccttcgccccgtcgcgcatgttgtcggtcaccgacaccgtcacatccatcgtaccgttacccgtagcaggcgataccgtaatccagtcgggcaaatcctccatcacccagtcggcatccgcatacacggtaattgttttcggctgcgccccctcagcctcaaagttcagttcgctggcacttgccagtacagccttcgagagcgtcgtttcctcctcgctgcaactgcccaaaaacgttgccgagagaaacagcaccgaagccatgatataattgatcagtttcatatttttttacagagttaaattgtttgtttgaagttgaagagtctttccgaagaatctccgtttcatcttcggaaaaacctgccgtaattttccggaagaaaaacctgaatccaattcttgttttatcctcggaaaaacctgccgatgtttcaagagcagtcagccgttccgtttcggaagagaagcctgaaacttagaagcccagaccatcgttccagcccggattctgcgtcaaattcgggttcagcgaacgttcgttgataggaatcgggtacagatagtcacgctcctcgttgaacggcgtacgcgcgatattcttgtgataatacacatacccgctgttgctgcccgtcagcaagatatccttaccaatctcatacaccagcaccccgctgtccgcactcggcttggcagtacccttggcatacagaatgacatccggctttccgtcgccgctcaggtcatactcacccgcaccggggaaatacataccatagatatcctgattgatgcaggcacccgctttccagcgcaccagatcgtcgaaacggaagccctcctgatccagctcgatggtacgttcgcggcggatttccagaatcacacccttgttgctgcccgtcacgttcgggtaacccgttgccgcatccgacaggtaacggtccggattggcattcgcctcactcattttcagatccggcatgcccacacgatggcggatcaggttgatggagttatccaggtcggtctgcgtcagcgtacccagttccgcctttgcttcggcatagttcagcagcacttcagcatagcggtacacaggcaagtcgttcgtattgcggtcgttgcggtccacctgtccgccggaagccgtcggctcctgcacgaacttgatcggctgataaccggtcacactgaccgagagatcgggaggcagcaccgttgtttccccgatacgggtataccccggggtacggatgctctgagccagacgcgggtcacggttcttggtttcctccaggaaagtcatttcctgccatcccggctggtcggtaaaccgactgccgtccttcatcagatacatattcaccatcttgcgcgtcagtcccggacggccctgcgtaggcaccagcgtatgtccgttggcattgtgatgaatagccagactatagtcgaacttgatagccaggatatactcgtcgggattggcatcctcctcggcgaagagcatcaggtagtcactttccggatgaccggtagaatacagcttgtaaggtccctgctccataatctcctgagccgcctgtgccgcctgatccagataataggtatagtcgtgtccctccagcgacagttcgtgatacttgcggtacgtaccctcgtacaggcagaactgcgccttcagcgacagtgccgcccagcggttcacacggaacgggctgctggtttcctccttctcgtcgggcaggttgtcgatggcataatccacatcctccagcatcttggtcatcaccagctcgcgcgagtcacgcggcttgtacagtgcctcgtcggcagaacccagttccacgtcgtaccaaggcacatcgccgaagcgtttcaccttttcaaagtagaagaaagcacggaagaagcgagtcagtgccgtatacttcaccaccgccttctcgtcgttacactggtcgatatactccagcagcgtattcatcttgcgcaggtcggtccacgtccatcccccgcccgaagcaggcacggtacggttgtttccgcccagcatctcgtcggaaagattctgctgcacatacacgtcactctgatcgtcgaaagggctcttgtccagcaagttgttgtaaaacgtgttgctgaaaagctgcaagtcgctttcggtcttgaaatagtcggtctgcgatatctggctttgaggagtcaggtcgagcaaaccgtcacacgaagtcaaccccattgtcagcaccagtgctgtaaatatatattttttcatctgaatctgttctttgttgtttactctatgaattctcgtttagaaagtgatgtccacgccaaacagcaacgtcttctgccacggatagaagctctcgttgtacgtatcgtcgctgcggctgatagctccttccggatccacgtacttggtaatcttcttcagcggcgaccagtagcagaggttttcgcccgagaagtagaaacgtgcctgatcgataccgattctcttggtcagcttcaccggaagcgtatatcccacggtcaggttcttcagacgcatgtagcggatgttctgcaaatagcggtcgttcaccttgctcagcggaccggaagtcgacgagtatgccatcggacgcgggaaataagcatccgtattgtcttcggcccacaccttgtccatgaaattcttctgcaggaacgtctggtaaggataagagaacgggccccagaacgacatcatgtgtccgtgaggataccagtagtggttacctgttccctggaagaacaccgatacatcgaatccgcaccagcgtacactggcattgataccgtacgacaggctgggcagtgagttacccaataccttgcggtcgcccggatcggctacattattgctgcctatatccaccataccgtcaccgtcgaggtcgacaaacttcacgtcgccggccttccagcctcccgtcagtccgtcggccatgtagctcaggaccaccttcttggcatagtcctgtgcctcctcgtcggtagcaaacagaccgtcggtcacaaagccccagatttctcctatgcgcatgccctcgtagtaatccttggcaaaggtcttatccttgttgtcgtatttcgtaatataacttctgtagttgctcacgttgaatcccacactatattccagcgggtgtcttcccagagcgaactggtctctccacgaaaccgtcacctcgtatccccgggtctgcaagtcggccgtgttcatatccggcacgctggcaccatacaccgccggcagctcaactccgtcggtcagcatgttcagcgtattgcgcacatagccgtccaccgtcacgttcaaccggttcttcagcatggtcaggtcgaaacccaagtcccactgttcggacgtttcccatgtcaggtccgatgccaccggcgcactcagcgtagagtattttgccatcgagctgccctcgccgaaagaatatccggcaaagttgctcagcgaaatcagtcgcatgtacgtataataagaagaaacattctggttacccaagctaccaaacgaagcacgcagcttcagattgtccacatattcgctcagcggcttgaagaacggctcttcggagatacgccatcccaccgaacccgaagggaagaatccccagcggcttccggcagcaaaacgcgacgtaccgtcgtaacgtccgctcgcctccagcaggtaacgtcccttgtagtcatagttcacacggccgaagaaaccagccagcgcatactcattctgtccgccgcccacttcggtcagcacttccccctcggcattctgtcccaccaggtcgaggtcgtccagcgaagtagaagtcaggttctgtcccgcagccgaaacatttttcaggtgcatccgctcgtagttgaaacccgccatagccgtcacgtgatgtgcctcgccgaaggtatcctcgtagttggcatacacgttggccgaataatagttgcgtgtgttcaccgattcagtcaactggttcagacctgctccggtagcatacgactccatcggtccgtccggatactcgcggtagaacaagttgttggaacggtgtgtattgcgtgtctgatacagacgatacgtaaagtcacccgtcaggctcagctgttcaatcggcttgatgaccagccgtgtcgtattcgagaagtccgtcgtacggtccacattacggtgcgaaccctctcccagcatgatgtgacgtccgttagccaccttgtagttcaggtaaggagtaccgtacagccatgagccgtccggattcttcatcgggaagcacgccagcgcatgacgtccgctgtaaccgatggtatcgtcgatgcttccgttaccctggaaagtatactgcgagccatagaacgaagtattgttgctcagcgtagcatagcggttgatggtaaagtcaatcttcgaacgcaggttatacttgcggtagatatccggattcatgttcaggatacctttctggtaatcgtatgccccgctcaccaggtatttcacatccttcgtacccccgctcagcgagatgctgtgctgctgagtaggacgacggtcgttgtacatcatgtgccaccagtcgtagttgccgtagtacacccactgacggcgaccgtttcttgtatcttccactacccacgggcggtcggggttctccgtcttgtcgttcacacgagccagcagctgctgcatgtcgtagtcggtatagtcaacgtagttagttccgttcttcgcctgccagaaggtattcaccgtatacaccgaccagtaaccggtcgtttcgtagtcggtagtcgtggtaggagcctgccatcccagacggccgctgtagcgcacgatagccttaccgtcctgcgccgagcccgacttggtggtgaccagaatcacaccgaatgccgcacgtgcaccgtataccgccgcagccgacgcatccttgatgaccgagatagactccacgtcattcgggttcacacggtccagttcgcccaccgcaccgtctatcagcaccagcggactggcactgttgatggaagtggtaccacgcacgttgatgctgggcgagctgcccggcacccccgacgaagtcgtaacattcagaccagccaccgaaccttgcagcatgctggccagcgactgagtggcacggttctccagcttctcgctgcccaccgtagccacggcacccgtcaggttcaccttcttctgcgtaccgtaacctaccaccaccgcctcatccagcatgatggcatcttcctgcatatataccacaatgtttttctgtcccggcttcaccttcactttttgtgtgaggtagcccacataagagaattccagggttgcccctgcggcaggtacctgtacatcaaacgcaccgtctacatcagtaattgttccctgagtagtcccctcaatgcgaatcgaaacccctacaagcggttcctgtaaggcatccagtaccttacccgataccttcctgttctgtgctgacagcgtagaaatactgcctaccagcaacagcaacaagcccaacacgtacgaattgaaaactttcataaataagtattaagtaaaacataagttaagtcagcgaggcaagtaagcatccgtcgagaaagccttcggacgctgcatattctccgtccactggtgtccgaactcgtcgcacacggtgatggtcaggtccacgtcggcatcggcagccttcaccttgaagaaatgcgggaacttctcggtaatgaagctcggcgtagaagtcagcgtcgacgagttgaaacgcttcacgctcatagccgccacgtgcagcgggtcgtacgcccatacctcctcgggagtcagcgtattgccgttttcgtcggtcaccttcagcgtccagcgcgggttccagttccacacgttgatcagcacctcattgtcctgattttccggataagcatccacatacttcatgtactccttcttgaccgaagccggtacaccggcaggcatctgcggcacatctgccagcgagaaatgcacgttgttcaggtcgtagctgcggaactggtaatcctccgtccatcccgtagccttgtacatccactccatgtccgtaccgttcacgctccagatagcataaccacccggcgtaccgtcggggctgaggtgcacgcccggagtaaggtatcccgaccaccaccaggagccgcagatggcacccgtgttatgttcgtacacctcccgtccgccagtcacggcatcatcgggcgtcacgttatagttcatgtgtgtatgtccggtaatgaaatgcaccttgtagccgtccagcacgttcagcaactgcgtcgtgttcagcacgtcgtgatccaccttgaagccgtccgtctgcgaaggatagaacacctgcgcgtgcatcactaccaccagcggcaccgacttgtctacgtgcgacaagtcctttgccagccagctcagctgtccggccgatacccgtttctcgtagtcgcgcgaagtcgtaccgtcgtaattgctgcaatcgatgtcatccagcaccacgtagtgtacctttcccaagttgaatgaataataagtaggcgcgatgtaatccatgaaacggctctccgcatcccggtcgttcgtcgccttatagtcgtagtcatgatttccgatggtatggaaaatctgaagccccttcacctgcgagttgatggtgttcaggtactcgggcagcgcgtaactgttggaataccagtacaagtcccaggtcatgtcgcccagcgcgatggcatacatcttttcctgctggtgcagcgcacggtaagcgttcaggtcgctggtaaactccatgaactgcttcaggtcgcccgtacggtttgccagatgcatatcgcccagcaccagcaccttatagtcatcctgtccgtccaccgccgtcagcgagaagtccacccgctcggcagtagaagcgtcgcccttcatcatcttgtagaactgagggagcaccccttcggcaggcacctcgtaacccgcaggaacagagatgaacacatatccccactccttgtccgactggagctggtagataccctgctcattggtgacggtcacttctacgccatccgaaaccactacccccggcaccggtccgtcggcagtcgaaaccaccccgtacaccgttgttccggcatccggcgtaaagtccattccctctacaatattaatataagtactgccgatctgtttcttgcggtcgccccgcttgatgaacacccggtacgtaccactctcgcatccttccgaaatctttacggtaaagctgttttccgacacactcaccagtgtgcaggtgtacgaaatgccgtcggtcgactccagcaccagcacatccgatgcctgcggttcctctccgccttccacctgaaaggtgtattctccgcccttgctgacttctatcagcgacggacaatcgaaactgacgccaaagctgtccgatgcaacttctgtcgcctcatccttgctgcatgccatgaggggcaatccagcaaccaacacaaaccaaactaaatacgctgcaatttttttcatgctatgtttaaattgtaaatctgcctaacccgttttttattttgcctattttttatctgtctggatattaaggtgttgtcattacctaaaaaaaccttaatttcctgtgcgcaaaattagatgcagcgtatttcaaaagcgaaacaccgatgtggcattcctgtttcaaaacggttaagtttgtgatgcaaggggagataaaaacggggtgtgaatacctgtctgtacggtacagcatattgccggcagataaaatcaaagcacaaatgaagctaaagaagttgtagcacagacttctaaactcgaatattgaacagccatactatttggcggaataaaaaataatgtttacctttacaatataaaagtgcccgtgcgagcttagtcgtcgcatctgcactacaaaaaggaattagagaagtctcagtcataatgactgggacttcttgcttttaacaatcatatcatcctcagaaagtttctttcaatctatttttcttcatccgattctgaaaaagcgtccaggcttccgtcgttaagtttgtgatgcagggcatattatatgtcaatcaggataaaagctttatccgacctttcctgtgcagactcctcctttatcactttctgatatgtgtccgagttaaagaccaatgaaagcgcctagggttagaaagaataacgtaaaggtttctgaaaattttcaattcaagagcctcctcccttagcccataggaggaatagctgtaccccaatacgatactcctccattggaatcagctgtaccaaaataaagctccgcacatattccgcttcctgaataagccaatttgactataatttgcgtataatatagacaactacacatatttgattcaaaattccatgcgccaccaacctttgtcttacaaacgcaaacagatgctaatgaagcagcacaagcacactgaaaaacaacttgcgtggttacataatccggataaaaagcatccatcccatactcttgtcccgttgtcagtattactccacctgtcttttcagggacaagcaaagtcttatcttctttttttaagattatccctatattttacaaactactctttgaagtctataagtttagcctccggatgatcttttacaaaccgatttaatacatcgatttcagaagcgatcctttggtattcttcattactaactcctaattctaatgcttcttcttcagatatatctaaagaatagaccctcttatttttatcaaccgaaacaaattgagacatgaaaatagaattcactctcatatcttttgcctcatcactcattcttttataaacttctaaaggcaaattctgttctgctacttcttgtaaatcagttttagacaaatgcaattcaaactgtgactcatgcaaatcaccagctaattcttcttttttttgctgacaagaaaaaaagcaaaacaaaaagacaagaccaatagaccatttcataactacaatgtgtttctaagttgttataaattcttttatatctaacatacagcaaatataagcttttcaatagacatcgtcgacattatgccatcaatgtctgtttcctttttatcaaaaaattctttaatggaaatctccccattcaactctcacggctcatagagtaagatattttgccagttcctgaatacccggcacgtctgtcaggatcctgcaattgtatatagcttttagtgtgctccattgcggttgttgtttttccacaccacttcggacccctttatctgtaccgctccaaaagcctccagacacaaggctaactcgtcatctacaattcttttccgataatctgtcaaatactattcaattttcatcaaatatacgacaaattatagacactccaaaagctacttcctgtttttgtgatattcattaaatgaagctaaagaagttatagcgcatacttccaccctcaatttcccgatgcaacatacacacaaaaaacggggtgtgaaccacgccgcgataccgcaaacgtgaggttcacaccccgtctatctattatacattcagcttctgcccgatatatttactctcctatcacatcacgcacacagcggactttacccgaagttccaccacctgtaagcaacatcagatttccataggatgcactaggattaaatctattatattcatatacatatacaaatcctggtctgttaggactaccgaagtcatcattataatcgccccatccattgaagctaaaccctgttttgcataaataatacgatgatgaagattcaccaaatttagtctcaaacaagtccggataagtagtatacatcagcatcagttcacgcaggttcggtgcacgatacccgtccgggcaaggattaccattattttcataattgtataagttattccacgtccagtaatcattctttggatacagtccactcgcattgtcataagaactattccatctatcaccctcagcactcaccagcaccgcgaatttccgataaggacggtcgttgtcatcgcgttctttgttttgtggcaaaataccaccggtcagtgctgcacgcagtgtattcggttccagacgggacaaatcaatgaaccgttccgtatacgttacagttccactgcctacttttaccttcctatcctttgttataatatctccattttcatcttttgatataacatagtcatccacctggctagctatagagctcaatgacaatcccagattacgcaagcaacggtacgtatatggaccattctcattctcatgcccaagatttccacgggaggctccttcttctgcccagataatccacggactcatcgtactagcagttatcgtattatacgtactgctgatgacatgttctttcggcacattcgtagatgtcgcattttgggaatacagcttcgcattgggcacggcagcttcagcaataaagatatccgtcagctggtctaccgaagccagataccagcggatttcgtcaagatctacgatattgtccccatccaggtcacggttacgccccaggcaggcgaaccatacacatttatatccctctttaagtcgtccgtagtccgcttcattcagataaagtacatccgtccacttcaaatcagtaagctgaccaagcacttccacagtattattacgtccatcgtcaaaggtattgttgcctttattccaagctataccattaagagcactactggtagccggaagattcgcatcttccgattcattcttaaactccgtaccccatgccgtacttacatcgctgtccggatcgtagaaagtatagataggccgctgcgagaaggtaatcacactctccgcccacgaagtatttccatccggactgtacagtgcgcctttcacacaaatatgcagcatacggttttctgcgtttacaaagtctttccataaagtcaaatccggatcatcatccgcaagcgctgtaggtatctcataaaacacttcggtaggattatacttatacacatattcatcgataaaggcagtaatggtaacttccgcatcatcatcatatgagactcccccatccttaagaaacaaatcacaaccttgctcttcactcttattcgcctcgataaacagatggttcagcaactggttcacgtcgtaaagcaccacatcctgactataaatagccgtagagccatcataatgataccctttacctccaaacgccggagccttatcactcaagtttgtcgaggaataagccttataccccggatatttggcaaaggctgaaggaggaacttttacattagtatgtccctcatcatctcgtaccaaaacacattcctgattaatagcaaactgtacccagcggtaatcgttcagcgaaagacccgtctgcagatttttcacctgatcagaggacaaacttgtagcatcacttaccacagtaccgtcctcgcgtttatcctttgtatagttactacggtcgaacaccttcagtccgcgctgaaacggagtactgatagcccacgacaaaccagcctttatatcccctctcgtcaacgagaatttcgcacgtccgtagtgagagtcaagatctaccacctcaccacctgccttaattacatctccttctactccgggacgttcttctttatcgctcacaacctcaacccgcatcgattctactcccgtaatggtcacattatacgtatagtgcgtattgcggcatacatcatagttgttcaccagttcttcgtcatcaggatcacttcccgtactacccagatgcacggtatacgtcacatcggcattataaaaatccgtaccatgttgaaaagaaagcgtaccccgtatcgtgacatacgtcgagttttccggagcaaagacaaagtcgcccggcacatactcctgtcccggctttgtttcgtcgacaggcttcccagtatccgattctctcttttcacgcaaggcatacaggttctgtacctccgaataattagtctctttctttattctctttgtcggctggcgacggttctccagcagatagaactcaaaatacgaccgatcgccgttctcacgctttgcttcgtcaaaataatattcctttccggcagcctgcatcgaagcatatccgttccccgtggtattctccatggtctccgcataatcttcgttgtcgcgaggcaccagataagttccctgcggaatattctccacctgataatatttgggagtgaacgtcatgttggtatatccttcctcactaccatctgccttcacattaaaggtgatacgcgcatccacccgctccagatcaattttatcggcagcccctaccagatttccctgtgcatctaccgcaatatccgttccaccttcggtgtttttcagctgtccgcacatcagaaaagccatacgctccacactcagactcaccgtttcacctttatccgtgcgtaactgagaagacaaagccttgaagtcatccagattcgttaccgcatccaactgttcatagctcagcgttcctactccggagtttgggtttgcaacggcaaaaatctgttgtcctgtacccgaatacatatccaaggtcacagtaccagaacccgtagtattgacagattgcagataagttttgcccgatatctccccgtttcgcttgaaagcaatgacaaacagtcgctgtaccgtctgctctaccgtagcatcctgtgccgaacgcgattccacagcactcgcggccacattgaacttcaggtttaccgttaccggcacaccctccttgatattgtaaccattcacaatttcttcgtctgcacaagccgtgagaatagccacaaggcccaacagccacacatatatcagtttcatctttctcatagtcattcctcctttcaattaaaactgggtacatcattcgttaccggattccagccgaccacctgccagtctattgtcacctgtttattaaccaacagcgagacattcacattcagctgctgcccggcttccagctccttcaactcctcatcgcctatcttaaataccacctcgtgtgtcttgcttccccaagtagccgtaagcttgtaggcatttccacttgtccacggatacagataacgtatgtatggcgacgcatcagctacctcaccgacaggtacttgcagtgcaccatccgttccaaattttactgtcctcatacctgcagtttcctgcggatattcagggagcttatcaacatccttgaacaaatatccctgacctgcagtaccatctatttgtacattcgtcaaaccgacagactctcctgtctggttatcgaaattcagcactactttgacaagcgggaaaagcagtttcatcgaagcctttttctgctcattcggtcccaccttaatcgtctcgaaagccgcctgaggaatcagactcaaagcagggttattgaaatctttagtaagaatacgtgctttcagcgcacccagatccacgttctttccctccagactttccccgccagtcaggaacgcatcctcattggcaatggcataaaagtcaaaattttcaccatccttattgacagtcagctccgaaaagtgaatgaccttctgcgtttcgccaggctgaatgtcatagctcacattataaatgatatcattcgtaccactgcgcgccacaattacacgcagtttgcgcatttgttcattgtccagcaggtttccggcagtaacattatccgaaacacgcgtagtgaaagtcatcgtgaccgaagccttccctcccacagccggatcgttatcctttatgcaagaaacagaaagcaaggctacagccactacagccactgccagcagacaatatgttctaaaatgttttctcatagtatgctcctccttacattactgccagtctggctcaatatcttctacataccattcgggaagcctgatacttactcccacctgatcgaacactatcgatataggcagcagcgcctcctgtttggttacatcaatatcttcccggtatctgttcaggtagttgaggatatttcctcttaccagttccacaccagtatttttatctttcagcaccagttggtgtgcacacgtcgtctcgtccagactggtttcatgatccagccggaacagagcaaagtcactggtatgatagcaattcttctctgcatcgtaaaccagttccggataaatggtacccttcacctccgtgttaatttcattctcgaacgaggtctgtgcattcgaattttcaaaactcaattcatacggtatgtcggcacggctttgcggagcaggcagaccgtaaatctctacttcggtatctacgtgcgagctgtacagcgtcaccgtatcccgatacatgacaccttcctgatcaggcataacaaactcttgctgacccatatagttgtcatcatgattaattacatttctcgaatcatcattccagaacggcgactggatataaatatccgaaagacggttggcatatatattttctacagccgtatggtcgtaggcatttcctattgccactactttgtaacgttttccatactgcagccggaacgacggtacagcatcaaagttcttcagctcgtcctgagtgtaatggccgacccccataatgtgtccgccctcatcgaaaacatacaggtctactttactcatgtacttatataatacgtccgtatcaccatctgccagatactggaaataaatggtgacattatcacaatcatccagatcttccttgacgcaactgctcgacaggacgaaaaccggcagtgccatcaacattattttcagaaactttatcatattcgttcttatgaatgttataaaactgtatgttttaggaatagagtctggcggatgattccgccagactttgattatagagaaatgaggttattgttcaacccattcagcagtagtatccacaacagaccaagttgcttcttcaacagttacttctacaccatacacagtttcaccaccttcattaggtccgatatgcttgtccatcagttcagcatttgtaatacggtaaattgtacctggaacgaactcggtaatttgttctccttcagaatctttataagacttcacaacagcataacgaggtgaagtaataggatcaccacctggaacagcagtagctgtgttgaaatatattttcagttcaggaagtgccttaccagctccggcaaataagttatacgcataagcttttccagtctctgggaataatgtgccatccaaaaagtctgagccaacaccaaagtcaccaattacatcatacaaaatcgggaagtttccagtaccctgtgtagagttttcattccatgaataagtattagtagcagaggctgcatcttttgttgcatagatattattcagataaacaccgttaattagcaatgtttcaaatttacaagacggttcttcagagttatcaccatcatgagctttgtgtttcagacctgacagttcaagacgtgctaccggaatttccaaggcaagtgatttagtataacgtttgtaaacttttccatctgtcggattttccatttcgccattaatatcagttgttgacaaagtttcttcatcatatgcaggaattgattctggagctgactgtaatctcgaatctgtaatggcaatgtcagtatcctcatatacattctttccatcattacaataagctaccaccttagaaggattagttacaccaaaaatctgtacggtgtaactttcttcgctgtccacatctggattcgaacgagaaatcgtagcagatttctgcagctcacttcctgaatacacttcaactgtaatatctccacctacgataacagtattaccggttgccgcattctgtacacttcttgtagaaggacttttgacagtaacctctaccatacccattccctgaatgctaccaccttctggtactacttcttcatttgagcaggcaaacaaacccaaacctgcaaacgcccacaataaactcttagaaaatttcataatacaaaaatttaaaagttaatactctcatatctaattattctcatttcagctgttttcctactccgccatcaggtccagatacgcctgcagtgccttcaggttctctgcagcaggagcatagcccgctttggaagcccgtccgaacgcttcaaccgccttttccggctgaccgttcttcacgtatgccgtacccagcatgttcagcagcgcaccgtcctgaggagccttctccagcagagccactgcctcgccggcacgctgcgcctccagcagcgccagtgccgcattgtttaccgccgttacgtcctgcggataagtcttcgcacccgtcagcaggcagtcgatgtactgcggcgtacccttgccgtagctgtccgctaccttgtgaatctcgctcacgctcatcagctgcgggctctcggttatcatcttgcgcccttcctctatggtaaagtgacgcacgttatactctatgcggtactcgttgcggcgcaccggagcatacacctcgttcaccagcttggtatataccgctgccggcaccagcttcttcagttccgcctcgcaggcatccttgtcgtcgccgcagccatctatcagctgcagaatctcctgctgctgctccagctccgtacgacgttccacctccttgcgcagtgcgtcccagtcctcgcccttccacgctacatggtacagcgagcggtctattccgtccagatcgcggcgcacatagtcggtaaacgcctgcgcacgccgtttcgacaagtccatgttgtatttcatcgtaccctcgggcgacgcataacccgttacgtaaatgcctgtaatcgtgaggtcgtgattgtcgcgcaccacctgaaacgactccttcaccttcgccagttccgcgcggttctgcttgtaagccgcatcgatgcggtcgctgttctggcggaattccagccgggccaccctcgtttccgagcggcgtttcacctcttcttccttcggctcgatgaacggagccacgtacaccggattcatggcaggaaatatagtgcctccgtaagccgtttcgctaccctcttcacactgtgcacagcccgtgacgtatgcccgcagctccacacttccgtctatcatccaccgcttgaaaggcaccgatgcctcgtacgaaaccgtctgttccgaaccgttgtcgcggcgcaccaccagcagcgcgtcctcgttgaattcttccccgtacaagacacgtgcacgctgctgtaccctgtcgcgcgtctttccgttgatgacaaacggaggcaactcctgctccatgctgccgtcggctgccacgatgaccggcaccacccgcagcgaatgctgtcggttcatcttcaggttgtccagcccgatttccattttcacgttcgccttgcggtccgccgttttcgtcacctgcggtccgtcgatgttcaccgcctccagataaggcacctgagcccctgccgaaacagcggcaaacaacattgctgcagaaaagatatatttcttcatcgtacgttcctccatcatttaattatgtaaatcaacgataccgccgccttggtcagcccgaagtaatcctttgtgtcggagcctctccactcgccgcagtgcggacagtcgtacatatcatagtcggcacggatccatcccgccccgatttccagtcccaggttccagcggtttcccagcacgaactgatagccgtagcccagtcccacgccgtacatgtttccctgataccggtaatccttgaacgaaggaaaaatcttcaggtccatatctgccacgttaaaacctccgcccagtgcatgaagagcaagaaaatgtccgttgaaggcttcacagaaccagtaccgcgcttccggttgtaccagccagtgcttcatcttccggtcatcacctaaattaaagggattatagtttcccgaaacatcaatgctccatttgggagctacccgaaactcagcccccacattcagcgttgtggttacatcataaagaaggtttgtcttgaccgctattttctgggctgatacggacatacctgctatcagaaaggttattaatgcaaacagttttctcatagtcctttgctcttaagtttttacgtagtacaaagttatcaaatgctaaaatactgtcaacaaaaattaatttccaatctgtcgtatgaaaaggaggaaaacagtagaaaagattaccaaaaaatcataacaaccgtatttacaataaattacaagaacaagaaatggacaatataagaagaaaattctacgttctatttttacattttattacgaaatagattaggactcataccatatttatccttaaacaaacgataaaaagtagacaaattaggaatagcactttgttcagctattttactaatagaccattcgggattctcgtgaaacagctcgatggcatattccagcctcaggctgttcaggtaagcagccagattggtgttgccaaactctttcagcacactggcaaaacggttcttgtccactcccatgatacgcgcatactggtcgcgccccagactgtagtcgaggtaaagtttctcctgacgcaccttcttgtcgaaaagggcaaacaattcctcgttcgaaaggcgcgaaaacgccccctttctgggtacttccggcactgcctgctccactacctcttccgcagccttttcctcctgtttgccggtatcggctgttttccttccggcatattgtccctttttcagcagatactggtgcagcaccttcagcttctccagctccacaatccgaatacgcatcttcccacctttccgcatgaagccccccagcgccagcagcgacagcagcaatagacccgccagcacaccgagccagatagtctgtacgcgcaacttctcctccgtttcctccagttcctcccgggcagccagcgcattaaacaggtcagtgttctccagcagatagttgcgctcgttattcagccgtatagcctgctggatagacatcctgcgctttgccaccgcataagccttccggtagtcgcccaccgcctcgtaagctacacacgcctgctgcaggagccgctcatacgaaatgttgagcgtatcacgccggtccatctccctgacgtatgcctgtgcgttcacgataacctgatcgtaattcttcatggtaagcaggtagtcgtttatctccagacgtcccacaagggttttcgagaaatgggtaccaagaaacaactcgtaatacttctcatcctcgaattccttccccagcatatgggcaagaaaagccaccttgctgtacagatagcccgactggttgtcgcgcctcagttccggcaggcgggaaagcagcttgctccgttccagtcctatctgccatgcctcagcatacttccggtcgctgatgtagtacatcatcaggaaaccatacgtatgcgacaggtagtaaatctcggtttccgattttcctccttccagcagcttctccgcacggaatgcacattcgtatgccttcttgctcaggctcagcctgcggtacagatagccttcggacaacagcatgccggcaagcatgacatgatccgaaatcgaagtagcatactccttgcccttgcggatgtaacgggtagccttgtccagcgaaaacgcaaagaccgacgcctccgccagtatcatagatatccgacggtacagcacggtgtccgattttatttctaccgaatgataggctttctcggcactgtccagcgccctcccaaacatcgacagacggaaataagcgcacgaacggatatactccaactgatacgacgggtactgtgccttctgctgcaggctgtcaatctgcctcaaggctacttgcggaaacaagtaagcctgttcccggagatcaatcagcctcgaagcagaatatccagccgcaacaacaaaagacaatatgataaagaggaaatatctcattttttatcgtatttttacaattttattctaacaaaatcggtgctgtaaaattatttacacctcaaaactacaaaataaattaataaaggctctttcttcaaaaataaaattattgtagtgtaagtaaaattgtcttaataccaataatcgagattgacctctttttcttacggctctcccagccccctcacgatcacctccacctccggcttcaggaaaaacttgcgatgcttgtcgtgccccagtgccgccagaccctcgcggatggaaggacagcggtacatccaccggtacaagttgcgccgtgccgtctccggcgaacggttcggaaaatacaggcaagccagctctgccttgccgtagatacgcagacggaatgttccgtcggattcatcttttttcatcgtacacctcactttttacgtcgtaccaccttcttgtgcggagccacccgctcgaaggccaaatcgtccatcatctccttcagtacggtgcccggacgaaaatgcacccataccttgcccagcatcgacggacggaagtcggcctcgcacttcacgccctcgctcttcactcccacctgcagcgaaccgatgtcacccagacgaataatctccccgttgcacagcccgttgcctatctcctcctccagcgccgtgagcaccgccagcgtgtccgccttggtcaccgtgcaacgctcctgaatgcgcaccgccatgtcggccagcgacaccaccccgcgcgcctgagcccgggcgtagtacgtcacccccgccgaaaggtcccgcggatcaacgcgcggcaccaccgaatatgtcaccgatctttccttcattgcctttctccttatacgattttcccggtacagccacatgcacgccctcgaactcgccgattttcgtcatgctgggattgtacccgtaatacactttccccgtcgccccgttacgatgcttggcgagggtagcgatccccattcccttggtcgagcagcccgtgtcgggatccacccggatgtgataccgctccggccggtgcagcagaatcaccagatcggcatcctgttctatcgccccgctctcgcgcaagtgacgcagttccggactccccgcccgatcctccgcctgacggttgagctggctcgacacgatgaccggacagcccagcgatcgtgccagccccttcagcttgcgactgcactccgccacctcctgctcgcgcgtacgccccgggttcaccgtggcaagcagttgcagatagtccacgatgagcagccccagctcccctttcgcccgcagcgacttggcgatgacacacaactgatcgacgttgatgtacggcgtatcgtccacatgcaccggcagcgcactcatccgttccgccgtgcgatgcacatcctccacctcctccgccgtgagcttcccctgccggatacgcagcgggtcggcacggctctccgccagcaccatgcgctcgcccagctccgaagccgtcatctccagcgtgaagaacaccaccggcacccccgccatcgccgcctgacgcgcaaagaacaagtcgagtgccgtctttccgtccgccggacgcgccgccgtgaaaatcaggttgcccggctgccatccccccgtcatctcgttcaggcgctgcaagcccgtaggtacccccgtgagtccgttcaccgacagctcctgccggcggtccaccagcgccaccgtgtcctccatcacctccggcatggggtgcaggtgattctccagcggcgagtcgtcgagcagcgcccccagttcccgctgcgtgccgatcagcacgtcgtacacgtcgcacgtcatgtcgtttgccgccgccagctcccgcgtcagcacctccaccagtcgcctgcgcagaaagtactggaacaagatggtgcagtgatactccagatgcgccgacgtagccacctcgcccgccagcttcgccaccgcaaacggagcgcccgcctcgtccagtcgtcccgaagcacgcagttcctcgcacaccgtaagcatgtccaccgccgctccccgcgcatacagtgcgctaatcgcctcgaacaccgcccggtgcgccgtaatgtaaaacatctccgcccgcaggctcttcagtgccgtcgactgtgccgtccgctccagcagacaggctcctaaaacggctctttctatttcttctgcgtaaatcattccccctgtaatctttaaaaataattttactgttgtttttctaatttttgaagtagtatctgctgagaatcaagctgatgcttattctcacgctgtatcgcttgaaaatcaaaccgatacattagtgtttcgctttatccggagaagcaccgccggcagaacgagcatcccgcttttcggagaacctcttcaaacagaactcccacaaagaacattgctgctgattgcacgcttcggcttttccgcgatgctcattctcacgctgttcatcttcacaaccgcccgcttcacgccgcccatcttcaaaacctcccgcctcacattgcaccgcttcacgtcgttcatcctcataacgttccgcctcacattgcaccgcctcacgctgttcatcctgcgctgcatcgcctgaaactcaacccgatgcattaccgttttgctttatccggagaagcaccgccggcagcatgagcatcccgcttttcggagaacctcttcaagcaaaactcccgcaaagaacattgctgctgattgcacgcttcggcttttctgtgatgctcatttacacgctgttcatcttcatgccgttccacttcacgccgctcatcttcatgctgttccatcgcaagccgttcatttccacgcagctcatcttcacattgcaccgcctcacgctgttcatcttcatgctgctcattctcacaccgctccgcttcaagcaacatcgccggtaattgctccgtccgttttcgtcctaccttgcgccgcaacacagaaaccagttttccatagcctttccgaatcctcggaaaacaaatctttttcatagtcagatcatccaattcttacatccggtacccctcaattgatcacgaaactcttcatcagcagatagttgagcgccgaccttgcccggtcgatggacggcagcagacagagatacatctccatgttgccgatagcctcctcccgctcggccagcgtcagcttgccccacgccttgcgcgccgcctcgatgtcgagtgcgggctgctgcgtcagtgcgtggtactgctcccagaacacatcgaacgactcgtcggtcaggttcttgggacgctcgcccgacttgcggctcaccttcaggtggcacagttcctcgtaatacagcagcttcagcttcgagccgtgggcggtacgcgccgtgctcaccaccccttccagctccagccgggcaataaaacgcctcgctcttcccctgctccacccgaaacgcaagctcagttcatgcagagaatattccatttccccccttttcagctcctccggtccttccccctgatcgctgaagcatgccttcataagcaaatacacataggcttccgcatcggtatgcgtcttgccgtacatttcgtcgaacatcgtgttcaacagacgcctcgaaagcgccataaatccctgttttccagggccctttaactccagacacctcacatccttcaaatttttaaaaagttataaactgcgtaaatccgtaaagcggacccccgatgataccaccagtggtaccacttaccactttgatttacaattacttattcactgaagcggaccaccgatgataccagcaacggtaccaccctttcctttttatattataaacaaagatataatcaaaggaagttttccgttccgaaaaacattccacacgccgaagcccgatttcgcaacccgatttcaaccgcctcgcgtgttccgccgacccgaagagccggaacagaccacggaaacggaacaaaccggaggtgaaggacgctctgcctgccgaagcccgatttcgcaacccgatttcgaccgcctcgcgtgttccgccgacctgaagagccgaaacaaaaccacggaaacggaacaaaccggaggcgaaagaaattttccagtccggaaaacacgccaattcaaagattattctatctttgcccccgaagacttcaaaacccgattacagacatcgccgtccggtccgtcagaaagtccgcttttaagcccctccggcaccgttactgccaggtaaacccgccggcagaaaggcttaaaaacacgcacggcaacatctgcaatcaagttacttcagtcgatgaatttcggtgtttctccgctttctgtgcgtaaaaatacgcactgagagtgtattaacctctgccataaacggcagagaaatagcaaaaccaaacattatgaagaattatggtgagattcatgcacgtactctatcgttcgtgtgaagtaacggaaaaacaaaagagatttttgttgataaccctcaagcgtttcctcgatcggcaataccgttcggcacgcgtgtcgaaaagtgagattcagcgcattacaggcacaggtacccatacctgttccgacagtcgcaactaccagatcagtaccctgtatacgttcttccgcgcgatagaacagatacaccggataaaatttgagtacctcacgctactgagaatcatcgaaaaaagtatcaacgaaggaactgagctcgtcatccacgaggtaaagcctggagaagaaattccagaagggagccagaagctgcttaggcgtcagaccgaaaaaaagtgcagatactaaagcgaagcgtccctgatttttgaggaaaacatgcatcggtcgctacggcacacctgccgcagtgctgcttgttgcatcccgcaaacggggaaatttctccccgaacgcatctctttttgtgcgttttttgtacaaaatacacgcatgttttgtacaaatttttaaaaattctcccgacgaccttcccaccggatgcactcgtcgggagaattatttttcccgacgtgcctttgtataggaggtatgccctcgtaaaggcactatgctaatgtaagtaccctgtttactttcagctctgggaaaatggatgtcaaaaggagagttaaaatgcgaaaaaagaatttttattatggataatttactatctttgcggcgaagaacgacttcctatgcggctgtgggagcatacctcctatacagaagtacgacgtgcgggatcttccacttatggagataacaaactgattcatagtgccttcaggcgctaggaaggagagaaaagtacactcgtttttcaacaaaatcaaaccaggaaaccaacagggaaaaaatcattcagaaaataaaataaatcatagaacaaaattattaattgtaattttttttcaatcaccgattgtttaaaaattttaagattatgaaaaaagaacaggtatggcttcccctgcagaccgtctacaacaaggaactgctggtaggcgactatctcaaggagcagggcatagagtattatatccctatgacatacgaacttcgcgacatggaggacagcgatgaatgctgccgtgtactcgtacctgccattcataacctgcttttcgtacggcactcctacgacaacgactggtgtaggaagtttgcggtacaggcacctcttcccttgtattttatgaaaaaggagcgcaacggaaccgacttctgtacggtgagcgagcaggacatgcagaacttcatgcgtgccactgaccctgagattcagggcacccgcttcatcgactcggaaaagctccggggcaaacgcagcgtccccgtccgggtagtacgccgcggtccgctatacggcgtcacgggcaagttcctccgctacggagggcgccactacatcgccatcgaaatgccacacagcaccgccctgctgaaagtcagcttcacatggtgcgaaatcgttgtcgaccaatgaaatacatctcctccaccatcatcgaattcgagcgtcccgacatcgaacacgtgccggcagaactgctgcgccgtcagagtaccctgctgcgggcgttctactacgagcactacgactcgttcgtgcgcggaggaaaatacatcgtacagtacatttattatacggtaaagaaaatgcgcaacctcacccgtctgcaactcgacaagcagtacagctccctgagccagcaggcggaaagcctcgcccccgccgaatccgccgtccgttccgacgaccgcgacgtggtggcatacgcctacggcactcccgccgacgactctcgcctgtccgactggctgacggctcatcacctgccccagccgctggcacgctttgccgacacaccggacaccgacgcaggcaaacggctggacgagctgaagaaggctgccttctacgccttccgcaagaacgccctgctggtggtggaaagcatggacggactgatcgccaacccgttgttctataccgttctcgacgaataccagacgcccgtatgcagccccgacttcccgtggctcagccgcaagaacctgaagctcatgcaggcgatggcattgtatcaacaaaacaatgacacaggaaagtaacgacatgcacaccttacattatttaagcaacttttctcaaaaccaagcatgaagttgcccatactgtggcattattaacagcttactagtaaatatttatttatatctaatttgacaaaatgattattgccgtagatttcgacggaaccatcgtcgaacacaagtacccttccatcgggaaggagattccttttgccattgaaacattgaagaaactgcaggccgaacgccacaagctgatactatggagcgtacgcgaaggacgcctgctggacgaagccgtacagttctgccgtgagcgaggactggaattctatgccatcaaccgcgactatcccgaagaggaaaagggacagaacaaccactattcgcgcaagctgaaggcagacgtctttatcgacgaccgcaacctgggcggactgcccgactggggaaccatctacgaaatggtacgcaacaagctttcctatgaagacctgatgcacaagtacgaacaggaatacgaacccgaaaagcccaaaggcttctttgcccgtctgatgggaaaataatcaccgaataaaaatctacaaacatatctatcttatgaaaatcaaagcattcacactcatactggtactactggcaggactgtcgggatgtacctcctacaaaaacgttccttacctgcaagatccggaagccgtaaaccagtacggaaaggaaattccgctctacgatgccaagatcatgcctaaagacctgctcagcatcacggtaaatactaccgacccgcaggcagcagctcctttcaacctgaccgtacagactccgctgaatgcggcactgaccaatatcaataccaccacgcagcctacgctgcagcagtatctggtaaacaacgacggcgagatagacttccccgtactgggacgcctcaaggtgggcggacttaccaaaaaccaggcggaagacctgatacgcgaaggtctgaaaccctaccttaaggaagcacctatcgtgaccgtacgtatggccaactacaagatttccgtactgggcgaagtaaaccgtccgggaaccttcaccgtgagcaacgaaaaggtaaacgtgctcgaagccctcgccatggcaggcgacatgaccgtatacggtgtacgcgacaatgtgaagctgatccgtgaggatgctaccggcaagcgcgaaatcatgctgctcgacctgaccaagagcgaccttatcctgtcgccctacttctacctgcagcagaacgacatcctgtacgtcactcctaacaagaccaaggcgaagaactccgacatcggtaacacaaccactaccgtcatctcggccacttccattctggtatctattgccagcctgattgtcaacatcctgcgataaacattttcctttaaaaatccaaagaatatacagcaaacattatgatagaagaacagaacctgaacaacgaacagcagcacgaagagagcatcaacctctatgccatcttcttcaaataccttgcctactggccctggtttgtggcaagcgtcatcgtctgcctcatcctcgcctttgtgtacctgcgctatcaggcaccggtgtataacgtaacttccgccgtacttatcaaggaagacgattccagcaagcgcggcatgggagcagcatccggagcactcgaggccatgcagagcctgggcggactatccatgagcaacaacttcgacaatgaggtggaaatcctgaaaagccgcaccctgatccgcaaggtagtaacccagctgggactttacactaccatggcaaaggaccgtatgctgggctacgacatcccgttgtaccagagttctcctatcaacgtattcatgtcgcccgaagaggccgaaaagctggaggcaggcgcccgcctgaaactgacctacacccctgaaggcaagctgaaggtaaaggccacctataccctcgatgaggaagagcagaaaacagaaaagactttcgacaagcttcctgccgtattccccacccctgccggtgtgttcagctttacggcaaacgactccatcctgaacgaatggaaaaagcaggaaagcggtgatatccgcctgacagcctatgtaggctcccctacagccgtggcaaagtcatacggtgaaaatctgacggtagaatccgcctcgaaaaccactaccattgcccagatagccgtaaagaataccgacaagcagcgcgctgccgacttcatcaactgcctggtagccttctacaaccaggatgccaacgacgagaagaacgaggtggcacagaaaaccgccgacttcatcgaagaccgtatcggcatcatcaaccaggagctgggcagcaccgaaacccagctggctgacttcaagcagaaatcgggactgaccgacctgaccagcgacgcccaactggccctgcaggaaaactccaagtacgaacagatgcgcatcgagaaccagacccaaatccgtctggtagagttcctgcgcgactatatcaacaatcctgccaacgaacaggaggtgattccttccaacgtaggcttgcaggaccagaacctgagttcggtcatcgaccagtacaacaacatgctcatcgaacgcaagcggctgctccgcacctcgagtgaaaacaacccagccgtggtgaacatgaataccggtatcgaggcgatgcgtcacaacgtacagactaccgtggctagtgtactgaaaggactccagattacccgtgccgacatcgaccgtcaggcacgcaagttcgagggacgtatcagcagtgcccctcaacaggaaaaggagtttctcaccatctcccgccagcaagaaatcaaggcacagctctatatcatgctgctgcagaagcgtgaggaaaacgccatcaccctggctgccactgctaccaacggacgcatcatcgaggaagcacaggctgacaaagatccggtatcgccgaaaaagaaaatcatcgcccttgccgcccttatcctcgggctgggcattccggtgggtatcgtctacctgcgcgacctgctgaaatacaagatagaaaaccgggaagacgtggaaaaactgaccgacgtatccattctggcagaactacctcgttgcaaaaagccggagcacggtgccatcgtggtgcgcgagaacaagaacgatatcatggaagaaaccttccgcggtctgcgtaccaacctgctcttcatgctgggcaagaccgacaaggttatcctcttctcttctacccagccgggtgaaggaaaatcgtttgtagccggaaacaccgccgtgagtctcgtctacctgggcaagaaagtcatcgtagtaggtatggatatccgcaagcccggtctgaacaaggtgttcaacctgagccgccgtgccgaaggtatcaccaactacctgagcgatcccgaccatgtgaaactgaccgacatgatccagcgctcggacatcagcccgaatctggacatcctgccgggcggaccggtacctcccaacccgaccgagctggtagcacgcaccgtactggaagatgccatcaaccagctgaaagaacgttacgattacgtgatactcgataccgctcccatcggtatggtgaccgataccgccatcatcggccgtgtggcagacatctgcgtatatgtatgccgtgccgacgtaaccccgaaagccggctaccgctacatcaatgtgttgcgcgacgagcataagttcccgaaactggcaaccgttatcaacgacatcgacatgagcaagcgtaagaacagctacggctacggttacggtgccaagtacggttacggtaagggctatggatatggttacggctatggttacggttatgaagccggaaacaataagaatcaacagaaaaagtaagataaaaatttctccttaatctgtaagtaaaattacgtattgactagcatggctctttcccataccttcgtactgaacttaaaacgagaaagagccgacagtgtcgtaaccaagctccagcagtacatcatcaactacccatcaagaaagtaaagaaagattgtgtctacctagaacagttctataaggaacgccagtagaaatattacgaggtacagagcaagtatctctactatttctacagcaaccgtaacattactctgcaaattatacgtgccgaacaggaacacctgcaaaacgatatgaattttgcctattaggtatacagtcaggtagatcaacagctgcacagcacatacaaagatacagtaagagaaaccaatatttgcggtagtggagccggcaactattgtactagaaccttcagaaactagtaagcattgtatattaattaaacgttgtacttttgtataaattttcaacatcaaagtgtggaataagaccgacgtaagcttagtcattgtatattaattaaacgttgtacttttgtataaattttcaacatcaaagtgtggaataagaccgacgtaagcttagtcatttagattgtatcggatgttcagcccccacacttttacatcagaatccggatagttcattgggcagttagaccccgcatttgcaatgatggctaaagatgtatagatgttgcgttgtaattataaaaaccattagcttatgacctacgttggaattgatgttagtaagttaacattcgtggttgcttattcttctgcaaaaagcagtaaaaccaaaacctttaagaatacagctaaaggtattcgtgagtttataaaaacgatatcagttgatgaacatcattgtgttatggaagcaacaggcaattataggtaagcattgtatattaattaaacgttgtacttttgtataaattttcaacatcaaagtgtggaataagaccgacgtaagcttagtcatttagattgtatcggatgttcagcccccacacttttacatcagaatccggatagttcattgggcagttagaccccgcatttgcaatgatggctaaagatgtatagatgttgcgttgtaattataaaaaccattagcttatgacctacgttggaattgatgttagtaagttaacattcgtggttgcttattcttctgcaaaaagcagtaaaaccaaaacctttaagaatacagctaaaggtattcgtgagtttataaaaacgatatcagttgatgaacatcattgtgttatggaagcaacaggcaattatagtacattgcttgtatatatgctttccgagtttggttttacagtaagcctggagaaccctctgaagataaaaaatttctccaaagtcatgctttcagtcataaagtctgacgagattgatgcacgtcttatagcactatacggtgagaagatgcaaccatctccatacagaatgcgcagcgattcaattttagttctcaaacaaaaacgtactgtcctacgccagctaaagaagcagttagtagcaacaagcaacctgaaaggttctatggaggttcttccaatttatgactctaaatgcaagaaaacaatagagaaaacgattgcttttctgggaaaacaaatcaaatatatggaagaagaactggcttcattagctaatgatgaattcaagaaacagatggatttactcacttccataaaaggtatcggtgtaacactagctgcggctttaattgtggcaactggtggctttacatactttgataatgcaaaacaacttacgcgttatcttggcttatcaccaacatatcaacagtcaggaacatctgtcaactttaaaggtcacataaacagaaatggcgatccaattcttcgaagtcaactatatgtggcagcattctcatcacttaggtgcaatacagaatgtaaagcatgttttgaccgtctacgatctaaaggtaaacctggtaaagtagctgttgttgctgtcgccaataaattggtaagacaggcctttgcagttgttacacaagataagccatatgttgatggatttatatcagtaaaaccataatcactcctgcggagggagcgccatgcggcaagggactgagcagtcaggcccgacgagttttcattatacatatgcataaacatacttataattgttaaatatattcaagtttttattatagttcatccaattttgacgtattgcctcaaagaataaaaaatatgaccttcgctgctgtaacaaaaatattaaaagtatgtacagcagcagtgattttgaaaggctgttcatccgctacaaggcggaagcaatgccacaaggtgaatccatccaggatttctgtttgagaaacaaggtaccctacaatctctttcataaatggtacaaggatacaagacatcaaatagtaccggtacaagtagaaggacaaccggaaatggatacacaatcctcaaaggaagtgtcctcttctcctactctggaaagaaaggagaatacggaaccctgtcctataagaatgatgatagacatccgtatgacaaatggaatacggatacagcaacgaaacttgacctaccggaacttgagaagtctgatagagaaactggagggattatgctgaatgtcacaggaatgaacagattttactatctgcgtaattttcacgatatgcgctgtaagtatgaacgggtactatccatcattcatcagcagctgaaccgcgaaccacaggaagatgaagttttcattgtcctgtccaaggacaggaggaaagtccgtctcttcagctatgacaggcgctcgttcagcctctatgagaaacgtttctgtgaaggttacaggttcatgcagttatgccgtcagggagatgaaatcatatacagcatacagtggaaggatgtagttgtgctgttacagaatcctgtaattaatcaattgaatatcaggtaaataattatataaaacatttgtttatgtcactgaaaatgagtatctttatggtataacaacaggtgacatggacgatcgtgaatttgaaaaaatactggcttcggccgaacaactgaggctccgcgaaaaacaagcggagccttggacagatcgttattccgatatgaattccatggaaaaatcaatgctacttgacgagcttttcgctttgcgtaaagcggataaggagcgtgaagcaaaacttctggaaaagctggaccggatgacagagcagctgatgaatctgaacgaaagctcacaagctcaagtcaaggttattgatgggctgaaacagatgatagccagtcgggacatcctaatagaaaaactccagaaggaaaatgcggccctgagagagcagaagaaacaggacagaaagaatctgtacgggtctaaaagccagaagatttcacgcaagaaaaaagaggaagcaccttctcatgaagagaacaaggatgactttgacggaacttcaggaccttcatccgtctctgcaagtgacgaaggtgctctttcacaagcaccggagaaaaaagaggaaagaccctatcgcaaggggatgtcttacaggcgtatgaaggcagacaagtcagtatgtcatgactcagacttcagccggctgccaaaagatgccgtaatcatcaagaccttctacaagtactcttaccagcagataagctatatattggagcacaaatatcaggtaatccgttacaagcagtccgacggcaagattcgtgagggatatttcccgaaagccggagaaccggactacatagatgtagttcccgggactcatgcatcggcggactttctggctcacctggcattcaatcattttgtgctgaatgtcccctactaccgtgaaatgtaccgtctatcggatcataagatgtccctgagccggatgacgctggtcaactggctcgccaaaggagccgcttttacaagcgctctgatagagagactgaaagaccgcgccatggtcaaggactccattgtcaactgtgacgagacctggtgcaaggtgaagatgaacagacatttcctgaaaaagtatgtctggtgcctggtaaacaaggaacagaaaatagcaatctactgttatgaggacggctccagaggacgtaaggttctcaagggaatcctcaaggaccggcaggtaaaggcgctgcagtcggacggttacaatgtttatatgtacatcgacaaagaactggtagacacggaacatctctgctgcctggctcatgcacgtgccaaatttgtctatgcatatgaacagggcgatgatcccgatgcaaaatatctgatagactgtttcggagagctttaccggctggaagatacttataaattaagcgggctttcagcacaggagataaccagctgccgacactcattgcggaccaaggaaattatagggcgcataagaagcaagctggatgtgctgctgtctccgactcatcctccccgtggagaactcatggacaaggctgtgaattatctgcaggttttctggaaacagctctttgcctatctgaacgatgggcggtatgacatagacaattcaatagcagaacgtttcatccgtccgctggcgggggagcgcaagaactcgctgttctttgttggcagccgcatggcaaatgtatcggcagcctaccatacgctgctctcaacatgccgaatgaacgggctgtctgctctggaatatctcaagaaattcttccacgaaattgtcaaagggagaaaggattatgaaaatctcctgcctatgacaattggaattaatactaacaaatattaataatcacgttcaatttttgatttttttaataggaaaccgctgaaaagcggctttccctatactacacgtcaaaattggacgctaactgaaagaatactggcttcggccgaacaactgaggctccgcgaaaaacaagcggagccttggacagatcgttattccgatatgaattccatggaaaaatcaatgctgcttgacgagcttttcgctctgcgtaaagcggataaggagcgtgaagcaaaacttctggaaaagctggaccgaatgacagagcagctgatgaatctgaacgaaagctcacaacgcttactgaagcaaaatgaggaacagcagaagataatctttgatttaaataaattggttgagaagcttcagaaggaaaatgcagccctgaaagagcagaagaaacaggacagaaagaatctgtacgggtctaaaagccagaagatttcacgcaagaaaaaggaggaagcaccttctcatgaagagaacaaggatgactttgacggaacttccggaccttcatccgtttccgcaagtgacgaaaatgctctttcacaagcaccggagaaaaaagaggaaagaccctatcgtaaggggatgtcttacaggcgtatgaaggccgacaagtcagtatgtcacgattcagacttcagccggctgccgaaagatgccgtaatcatcaagaccttctacaagtattcttaccagcagataagctatatattggagcacaaatatcaggtaatccgttacaagcagtccgacggcaagattcgtgagggatatttcccgaaagccggagaaccggactacatagacgtagttcccgggactcatgcatcggcggactttctggctcacctggcattcaatcattttgtgctgaatgtcccctactaccgtgaaatgtaccgtctatcggatcataagatgtctctgagccggatgacgctggtcaactggctcgccaaaggagccgcttttacaagcgctctgatagagagactgaaagaccgcgccatggtcaaggactccattgtcaactgtgacgagacctggtgcaaggtgaagatgaacagacatttcttgaagaaatatgtctggtgcctggtaaacaaggaacagaaaatagtaatctactgttatgaggacggttccagaggacgtaaggttctcaagggaatcctcaaggaccggcaggtaaaggcgctgcagtcggacggttacaacgtttatatgtacatcgataaagaactggtagacacggaacatctctgttgtctggctcatgcacgtgccaaatttgtctatgcatatgaacagggcgatgatcccgatgcaaaatatctaatagactgtttcggagagctttaccggctggaagatacttataaattaagcgggctttcagcacaggagataacccgctgccgacactcattgcggaccaaggaaattatagggcgcataagaagcaagctggatgtgctgctgtctccgactcatcctccccgtggagaactcatggacaaggctgtgaactatcttcaggttttctggaaacagctctttgcctatctgaacgatgggcggtatgacatagacaattcaatagcagaacgtttcatccgtccgctggcgggggagcgcaagaactcgctgttctttgttggtagccgcatggcaaatgtatcggcggcctatcatacgctgctctcaacatgccgaatgaacgggctgtctgctctggaatatctcaagaaattcttccacgaaattgtcaaagggagaaaggattatgaaaatctgctgcccatgactatcggaattaatactaacaaatattaataatcaagttcaatttttgatttttttaataggaaaccgctgaaaagcggctttcactatactacacgtcaaaattgggtaagcgtccaattttgacgtattgcctcaaagaataaaaaatatgaccttcgctgctgtaacaaaaatattaaaagtatgtacagcagcagtgattttgaaaggctgttcatccgctacaaggcggaagcaatgccacaaggtgaatccatccaggatttctgtttgaaaaacaaggtaccctacaatctctttcataaatggtacaaggatacaagacatcaaatagtaccggtacaagtagaaggacaaccggaaatggatacacaatcctcaaaggaagtgtcctcttctcctactctggaaagaaaggagaatacggaaccctgtcctataaggatgatgatagacatccgtatgacaaacggaatacggatacagcaacgaaacttgacctaccggaacttgagaagtctgatagagaaactggagggattatgctgaatgtcacaggaatgaacagattttactatctgcgtaattttcacgatatgcgctgtaagtatgaacgggtactatccatcattcatcagcagctgaaccgcgagccacaggaagatgaagttttcattgtcatgtccaaggacaggaggaaagtccgtctcttcagctatgacaggcgctcgttcagcctctatgagaaacgtttctgtgaaggttacaggttcatgcagttatgccgtcagggagatgaaaccatatacagcatacagtggaaggatgtagttgtgctgttacagaatcctgtaattaatcaattgaatatcaggtaaataattatataaaacatttgtttatgtcactgaaaatgagtatctttatggtataacaacaggtgacatggacgatcgtgaatttgaaaaaatactggcttcggccgaacaactgaggcttcgcgaaaaacaagcggagccttggacagatcgttattccgatatgaattccatggaaaaatcaatgctgcttgacgagctttttgccctgcgtaaagcggataaggaagaaagggacagacttctggaaaagctggaccgaatgacagagcagctgatgaatctgaacgaaagctcacaagcgcaagtcaaggttattgatgggctgaaacagatgatagccagtcgggacatcctaatagagaaactccagaaggaaaatgcagccctgaaagagcagaagaaacaggacagaaagaatctgtacgggtctaaaagccagaagatttcacgcaagaaaaaggaggaagcaccttctcatgaagagaacaaggatgactttgacgggacttcaggaccttcatccgtctccgcaagtgacgaagatgctctttcacaagcaccggagaaaaaagaggaaagaccctatcgtaaggggatgtcttacaggcgtatgaaggcagacaagtcagtatgtcatgactcagacttcagccggctgccgaaagatgccgtaatcatcaagaccttctacaagtattcttaccagcagataagctatatattggagcacaaatatcaggtaatccgttacaagcagtccgacggcaagattcgtgagggatatttcccgaaagccggagaaccggactacatagacgtagttcccgggactcatgcatcggcggactttctggctcacctggcattcaatcattttgtgctgaatgtcccctactaccgtgaaatgtaccgtctatcggatcataagatgtctctgagccggatgacgctggtcaactggctcgccaaaggagccgcttttacaagcgctctgatagagagactgaaagaccgcgccatggtcaaggactccattgtcaactgtgacgagacctggtgcaaggtgaagatgaacagacatttcttgaagaaatatgtctggtgcctggtaaacaaggaacagaaaatagtaatctactgttatgaggacggttccagaggacgaaaggttctcaagggaatcctcaaggacaggcaggtaaaggcactgcagtcggacggttacaacgtttatatgtacatcgataaagaactggtagacacggaacatctctgttgtctggctcatgcacgtgccaaatttgtctatgcatatgaacagggcgatgatcccgatgctaaatatctgatagactgtttcggagagctttaccggctggaagatacttataaattaagcgggctttcagcacaggagataaccagctgccgacactcattgcgaaccaaggaaattatagggcgcataagaagcaagctggatgtgctgctgtctccgactcatcctccccgtggagaactcatggacaaggctgtgaattatcttcaggttttctggaaacagctctttgcctatctgaacgatgggcggtatgacatagacaattcaatagcagaacgtttcatccgtccactggcgggtgaacgcaagaactcgctgttctttgttggcagccgcatggcaaatgtatcggcagcctaccatacactgctgtcaacatgccgaatgaacggactgtctgctctggaatatctcaagaaattcttccacgaaattgtcaaagggagaaaggattatgaaaatctcctgcctatgacaattggaattaatactaataaatattaataatcacgttcaatttttgatttttttaataggaaaccgctaaaaagcggctttccctatactacacgtcaaaattggacgctaaccaaaattggacgctaacacattaagcaataaatgaagcaagccaacaaaaattttataacaaatatattatatttaattataaatatagcaataggagtcctatatactccttacttagtaaaacacgttggtattatagcatatggaattgtcccccttgcactaatcataaatcaatacattaatgttatttcgttaccattaatcaatgccttaacaagattttattctgttgagtacagaaaagggaactttaataatgcttctaaatatctttctacctcaattgttgtaagcataatttttacaataatattatacccattaatgcatatagctataaactatattgacttattatttgatatcccagaaacactattagataatgcaatattactttttagacttactatagctagcttctttatttctattatttctaattgcttaaatacaacccttttttcaaacaacttacttaattatgttaactatcttaagatagttcgtcaaacttctaaatttatactaaatattattttctttatttgtatagatataaacattatatatataggatggtctaacttcatttctgagatgcttgtattaattctaaatatatttttttacaagaaaacaaaaccacaatatatacattgcgattttaaactatatgacaaaaaatatttaattgcaatgttaggaatgattatttgggtattagttcaaagattttctgatacttttttatataaaatagattctgttttaatgaatctattttttggaataaaaatgacaggtataattggcgctatttctgaatttggaagttacgtcatatctataacaactattcttgtatcattatttggtccactattattaatagcatattcccaacagaaatataaagattatattgaaaaaacaattcatggaggatatttagtcggcttgttttcaagcctcttatgtgcactattgtgtggctcagcaagccttttattaaaaatatggttaggtgcagaattcgaacaatactcatcatggatgattataaaattattgatcatcccttatacaactgttggtgccatttattccaatagttatctttatgctaattacaataaatatccagcattactatcaatagtaattgctttatttaatattatcatcaatgtattcattttaaatatacaaccctctataaatatcttcttaataatatgttttacttttatgttaatccagggatttgcaatgaacatatttttttacaatcgtttatatccagggaaactcaaagaaatcatcattttgacctctaaatataccatatattttatattactgtattttataacgcttatatcaagttcactatataatatagaaaatatatatcaactatttatcttatatagtattttattctgtataggaatcattgttttagactcgatattcttatctaataaacaaagaaacatgttatatgaaatacttccgctatataagactataagattgacaattttaaatagaatcataagatgaaaacttatattaacaacatattgtttcttctaggtattatagtttcagggtatatactattcaattcaacacacaaaggatatacaaattattacctagtaccactcatatttgctatttatgtcaaattagataaggaaatctatataagagcaatgaataatgtaggttttgccatgttttttatttctagttgcttccggttttatatagttccatttattacatgcgcctccaaatatgcagttattctaggaatgtctccaacaattcaagactataaggaagcggttaatttagcaatatacgaagaaattactatattatttattttttatacaatactacgaaaaaaattttataaaacagagtactacctctccaatcaagttcaaaaaatagaactaataaaatcacataaactatttacatttataattgtcacatcattactaattatactgctgatacctcaaagtatttcaaacataaattttattacaaacttaggaaatataaatttagcagaaacaatagtgctaaacttccctttagctggattatgcacagctattataaacttaggacgtttttttacaatcctattactaatcaactatttctacaagaaaagtaaacaaggacacacattattttacattataatatccatttgtattatacttctaaacgcttcttttgtcactaacttaagtagatttggaatgattgttcccattatcagttttacatatttacttttaaaaatatatgataattataaaacaaaaatcatcaaaataatgattttatgtactacaattattattgttggtatgtctgcaattaaattcttctctgaagatagaaacacaaacgcaaatgccagtaatgaagttactttttggggggaaacattacaaacttattttatgggaataaaagaaatagcagtaggtatacatgctaaagatagaatagatggtatatatgaaaataataaaatagcacttttttttaatgatagttttcaaaacatattaggtttaagcaacttaacaacacctcaactaaatacaaccagattatataattatacctattttccaaacagcagatcaatcagtcaaattccacctaatataataaatggattatactatttcggatggtttttagcacctttatatatattattatttatttatatgttttcttatttagattataaggttcataggaactctaatatagtactcaaatttgcattcttgtatggtgccctttactgtggtttatgcatgatgattaatggtgctatgctcatttcatttctaattaatgaaatgcttgctattataatatgctttaaactaaataaaaccaatactaatagaaaataaattcaatatggaacaagtgttttttgtagtagaaaactatattcctagaatgagcggagttcctatagtcgtacaatatctagcagaaggactggctcaacaaggatacaatgtaactatctgcaccagactttataaaggattaccacgccaagaaatcatcaatggagtacaagtatatcgattcgatataagaaaaacaatgatgaagcgatatgtcggagaaatagatcaatatcgtaattttattctaagcagccatatagatgtattaatttgcgaatgttctgaatgttcaactacagatatactactaaaagatctgcacaagataaaggctaaaaaaatatttcactcacatggctttgcaggaatgagattaaagtttctgaaatggaatacaaatcttaaatatacactggggaacacatacaactggttacgatttaaatggtattacaatattacctttaagaaatatatacaagacttcgatgtagccttatgcttatcagatgttgatagcagtaaaaaatggttagaaaaaaattctaaaaaagtaatcgtattgcaaaatgctgtaaatgacatattttacaattctacatctaatcaacaaatttatccagccattgctgatttaaataaaaattatctattatgtgtagcaacatacagtaaacaaaaaaaccaaatagatatagtaaaagaatattttaaaaccaaaacagattatgctttggtttttataggacctgaggaaaatgaatattatcatctcttaaaaaaagaaatcagtaacttagaaaagttttatgggcacagagatatcctcacccttactcatgttccacgttctttcatacctaacataataggcaatgcttcactatatttggtaggaagtagatttgaagaatattctatatcactaattgaaacaatggcaaaaggtattccttttataagtactaacgtaggaaatgcgtgcatattaccaggaggtattacaatcaataaaataagtgaaatgcataatcaaatagacaatttgctaaaagataaagaaaaatacgaacaacttagcagattaggaaaagcatttgtagaagagaattgtcgaataaataaagcagttaaattactaagttctattataaaatctgaaaaatgaaaataataacatttcaagcaggattaggaaaccaaatatttcaatatgcatactatttgcatttatgcaaaatatttcctaatgaaactttttatgggttttatccgaaaagagctctcaaagaccataatgggttagaaatttgtcaatggtttgacatagaattacccaaatcaaccaacatatctaattttatagcttatacattattttggataaacaagctttgttggaaattacaaataccacattttctcactgatacagattggtttagaaaaccaaacgctatgttatattcaggcttttggcaagataagcaatattttctagaattaaataatttttcttttaaaaaggacttaattctgagtgaaaccaataaacatattctacaaaaaatatgcgcaacaaactctgtagccgtacacgttagaagaggtgattatacaaatcccaaagttcaacatatctatggaaatatctgtactttagattactacaatcaggctataacaatagctaaagaaaaaataaacaaacctgaatttttctttttctccgatgatcctgaatatattgaagcaactttcaaaaatataaaaaaaacaattatcacatggaataaaggtaaagacagtttcttcgatatgtatctaatggcacattgtaaaaatatgattctagctaatagtacatttagttgttgggctgcttacttaaataaaaaccaaccactcgttatttgtccccaaaagtggcgtaatgaccgccctaccccccccgttattttaaataattggattacattatgaaattaaaatcaataccaggactagatgttttaaaattctcaatggctctactagttgttgccattcatgcagaagcagttaacatatataaaaatatatatgcaataatacaccccttaacagatattgcagttccattatttttcttaatctcctcttttcttgtattttcaaaaataagattaagcaatgatagtagagaaacactactacatttttcaaagaggttattaatactatatgctttttggatgctcattcaaactccattagttatatacacaagagattatctacaacaagatttattaacacttcccttatatattattcgtgatatactcttctgttctacctttcatggatcatggtttctatcagcattagtaattggagtatggcttatttttttcttatccaaattcattacagataaatatatttggatattacctttttttatttcaatatatacataccattacgatttatttccaactaactggcattatttatatcaatggtatactaatacttttcaaactccattaaattcatttcccgtttctttaatgtggattacttgcggatatatattatcaaatatacaagtatcaaaagtcattagtaactgtaataacctcattctaatatcaatatttattatttcttggatactaagcattatactatcatgggatatgcgtttttttatggtatcatctttatttattttaagttttaattggaatataagctacaaacctatacataaatatatgcgtcaaagtagtatacttatttatattacacatttcatttttatagtactgtttcgtcatctttttcccaaaatagaaatactacaacatggaataattttatatataattctaattattctctgtttactaacctcatttattattctaagattaaaagaatataaaatattttcttggctaaaatactcatactaacatgcaaaaacgattgttttatcttgatgtaatgaaaggaatattaattatattagtaatattaggacattcaatacaagatacaatttctgattatcaaaataacttcttatttcgctttatttattcttttcacatgcctctattttttgcaataagtggttatttaacattcaaaaataaatatgacaaaacgctactaaaaaaacgagccttgcaacttctagttcctttcggagtatgggcttttgctttaccgatttgtacatatggcattttagactggaacaaaacacaaaaaatattgctttatcccgataacggattatggtttctctataacttatttatttatagtaccatatttaatgcaacagaacgatggaagacaaaaaggtttggacagacatttctcttttgtatctgttacatcatattatgtattttaatgactatatttcataaattgtttaatttcacacaaatatgttggtacctaccattttttgccataggattctatctacataaatatgaaagatcgatacaaaaatataataaagctattttatggactggaacaattctttatatgtgtactatacctttttggatgatgagagaagaacctttattttataaatggataaatttaggtaatgtattttcttacttttatagatatgctgttgaatttattggtacaatattatttttcacagctggaaaaaaattattgaaccaccatttcatagggctaaaccaaataggcagacagacattaggtatatatgcttttcagttcatcacactttatcatataagtaaacttataactctacagaatgtatatgtgaatattttttttaaaacaatattcacattgataactagttatataatagtgttgattatcgaaagaataaaatttatcaatttattatttatagcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgttataggcaaagctaaatgaaaacaattacaataataactcttcaaaacatacgtaactacggttcagcgttacaagcacttgctactcaaaaaattttcgaacaattaggcttacaggttgattttatcaattatctacgtgaaaacgcttgttcaaataagaataaaattaaaacgtggtgtcaaggtatgcctctattaaagaaactcttttactcttgtgcactatatccatctttcctattaatggataagaaattcaatagatttcttcaaggtcatctccatgtacaaaaacaaacttactctacagaggaagattttaaaaaatttcctataacatcagatatttactgtacaggaagcgatcaaacctggaatagcggatggaatggcggcgtattaccttctctatttctcagttttgttccggacaatattcccaaaatagcctattcggccagttttggaaagtccaaactagatgaatgggaaaaagaagaaacccaaaaattattacagcgataccaagctatatctgtacgagaaagctctggggtagatattatcaataatttaggaatttctggagctgttcatgtactagatccgactttgcaattaaacaaagatttttggaaacaatatgctggtaaaagaaaaattagagttccatatctgttgatataccaattaaatacaaactcccagttcgataaatatgctaaagaaatggcaaaacggaaaggattaaagttagttcgtttttgtacacgtatcgaccaatgcattaaatgtggaaaatcattaatcatcccagaagtattggactttgtatccctaatttatcatgcagatttagtaataacagattctttccatgctacagccttcagtattaatgttaatactccatttatcagtatatatccagatagtttcggaggtcgtttagaaagcatactcaagcttactaaattagaaaacagacatctcaaatcgtatactgatttttcatatgtaacaacttccaaaatggattttacttatgcaaatgaagttttagaaaaagaaagagaaaaaggatacaaatttcttaaacaagcactaaagataaaattataattatcaatctaaaaaaatagcactatgtatactcctctaaaaaattatcagataatcatatcattattaaaacaaaataatataaaacatttggtattatcagcaggtacaagaaatattccatttgtgcaatctgttgaaaatgatcccttctttacttgctactcagtcgttgatgaaagaagtgctgcttatatggctctaggtatttcacttaaattaaatgagccagtagtaatctcatgtacatcttctacagcaacatgtaattactttcctgctatcgcagaagcttttcaccaaggagcacaacttattgttttaaccagcgacagaaaccctgccttattagaccaacgtgaagaccaaatgataaatcaggtcaatatgtatggaacatttgtaaaaaaagctgtaaatcttcctattattcatacagaagaagacttatggcattgccaaagacttgtcaatgaagccattttagcaacaaattttcatggaaaaggtcccgtacaaattaatattcccatgctaaattatgcatcagtctgttctgaaaaaaattgtttaactgctcgaaaaattaacagaataaaaattgaaacagaaaatactgtatgggaacaattagctcaaaaattaaactcagctaaaagaataatgattatttgcggacaaaataattatacttctcctctattaaatcaattacttagccaatttactaaactttataaggctgttttactcgctgaatatatggccaatatagagtgtgaagaagctattaatccttttttaccttttgagactcatgtaatgtcgagtgggcgttttgaagaatttataccagatatagtcataagcttgggaactaatgttatgtccggtattaaacagcagttaagagataaagcaggtcgatttgaacattggggtattgaagaaagtggggatatcgtagatatgtataaaagccttatcaatgtatttgagtgttctcctgaatatttcttccaatattttattaaaaaatttaataaaactatagaacgttcagatgagtatataaactatgtaaaagactataaatcaaagctgaaatatcctacactaaaattctctaataatacagttataagagatttagcaaaaaggatacctgataattcagtactacatctcagtattaataacagtatccgcttagttaacttttttggcttacccaatagaagtatcaaagtttttgccaatattggtactcatggcattgatggttgcttatcttcatttatagggcaatcagtagtttcagattctaacaatctgaattttctcattataggggatctcagtttcttttatgatatgggagctatgagaattaaacacatacctaagacttgtagaattctattaattaataattacggaggtggggaatttcactatagcacaacgctactgaaagaccctacaatggatttacatacaagtgcagctcaccacaatacagctaaaggatgggtagaatctgttggatttaaatactattcagtacacaatgatgaagaatatcagcaagtcttaaatattttcttatcgaaggatagtgaacaacctatactcattgaagtcttttccgatatggaagtagatgcaacaactacacatgcattggagaatataaacaagtatgaaactacaaaagaaaatattgttagaaccataaaaaatactgttgtagatgccataggagctccagctgcaaagagaattataaacaaattaaaatagttactgtcatcatgggttataaaaaaattataaaaaaaatagcgcaatttatattaacatctcaaccaaataactttgtcacagtaaaaacagaatcgattaattacggacacattttaaaaaatcaatcaatagttattactggaggcaataaaggtattggatatagtattgcaaaaaaatgtatttcggaaggagccaatgttctaatactaggtagagatttagatactctcaaaaaagcagctgcaacattaggtaatcaatgcaaatttctgcaatttgatgttactcagactaaagaataccctaatctttttgaaaaatgcaaaaaaattttaggagggagtatagattgttgggttaataatgcaggtcattagtgtccaataaaaatggactagttaaaaaattaatcaaatagtccttcaaaaaggggataatcgagttctttgacatcgttgaaatcagtcttatcgaacagttcacgcaagttagttttgtccgttagagagatgcttagaatctgcaaaacttcagtaagcgtccaattttgacgtattgcctcaaagaataaaaaatatgaccttcgctgctgtaacaaaaatattaaaagtatgtacagcagcagtgattttgaaaggctgttcatccgctacaaggcggaagcaatgccacaaggtgaatccatccaggatttctgtttgaaaaacaaggtaccctacaatctctttcataaatggtacaaggatacaagacatcaaatagtaccggtacaagtagaaggacaaccggaaatggatacacaatcctcaaaggaagtgtcctcttctcctactctggaaagaaaggagaatacggaaccctgtcctataaggatgatgatagacatccgtatgacaaacggaatacggatacagcaacgaaacttgacctaccggaacttgagaagtctgatagagaaactggagggattatgctgaatgtcacaggaatgaacagattttactatctgcgtaattttcacgatatgcgctgtaagtatgaacgggtactatccatcattcatcagcagctgaaccgcgagccacaggaagatgaagttttcattgtcatgtccaaggacaggaggaaagtccgtctcttcagctatgacaggcgctcgttcagcctctatgagaaacgtttctgtgaaggttacaggttcatgcagttatgccgtcagggagatgaaaccatatacagcatacagtggaaggatgtagttgtgctgttacagaatcctgtaattaatcaattgaatatcaggtaaataattatataaaacatttgtttatgtcactgaaaatgagtatctttatggtataacaacaggtgacatggacgatcgtgaatttgaaaaaatactggcttcggccgaacaactgaggcttcgcgaaaaacaagcggagccttggacagatcgttattccgatatgaattccatggaaaaatcaatgctgcttgacgagctttttgccctgcgtaaagcggataaggaagaaagggacagacttctggaaaagctggaccgaatgacagagcagctgatgaatctgaacgaaagctcacaagcgcaagtcaaggttattgatgggctgaaacagatgatagccagtcgggacatcctaatagagaaactccagaaggaaaatgcagccctgaaagagcagaagaaacaggacagaaagaatctgtacgggtctaaaagccagaagatttcacgcaagaaaaaggaggaagcaccttctcatgaagagaacaaggatgactttgacgggacttcaggaccttcatccgtctccgcaagtgacgaagatgctctttcacaagcaccggagaaaaaagaggaaagaccctatcgtaaggggatgtcttacaggcgtatgaaggcagacaagtcagtatgtcatgactcagacttcagccggctgccgaaagatgccgtaatcatcaagaccttctacaagtattcttaccagcagataagctatatattggagcacaaatatcaggtaatccgttacaagcagtccgacggcaagattcgtgagggatatttcccgaaagccggagaaccggactacatagacgtagttcccgggactcatgcatcggcggactttctggctcacctggcattcaatcattttgtgctgaatgtcccctactaccgtgaaatgtaccgtctatcggatcataagatgtctctgagccggatgacgctggtcaactggctcgccaaaggagccgcttttacaagcgctctgatagagagactgaaagaccgcgccatggtcaaggactccattgtcaactgtgacgagacctggtgcaaggtgaagatgaacagacatttcttgaagaaatatgtctggtgcctggtaaacaaggaacagaaaatagtaatctactgttatgaggacggttccagaggacgaaaggttctcaagggaatcctcaaggacaggcaggtaaaggcactgcagtcggacggttacaacgtttatatgtacatcgataaagaactggtagacacggaacatctctgttgtctggctcatgcacgtgccaaatttgtctatgcatatgaacagggcgatgatcccgatgctaaatatctgatagactgtttcggagagctttaccggctggaagatacttataaattaagcgggctttcagcacaggagataaccagctgccgacactcattgcgaaccaaggaaattatagggcgcataagaagcaagctggatgtgctgctgtctccgactcatcctccccgtggagaactcatggacaaggctgtgaattatcttcaggttttctggaaacagctctttgcctatctgaacgatgggcggtatgacatagacaattcaatagcagaacgtttcatccgtccactggcgggtgaacgcaagaactcgctgttctttgttggcagccgcatggcaaatgtatcggcagcctaccatacactgctgtcaacatgccgaatgaacggactgtctgctctggaatatctcaagaaattcttccacgaaattgtcaaagggagaaaggattatgaaaatctcctgcctatgacaattggaattaatactaataaatattaataatcacgttcaatttttgatttttttaataggaaaccgctaaaaagcggctttccctatactacacgtcaaaattggacgctaacaaaacttcataagttgagcgcttcaattgcatatcgtgttggacaatagccactagacagtaagtgatgattgctacactgatttgaatgcggacagcattttccgttgtgccccagaatctttttattttaaggtgctgcttgagccatttgaagaatagctcgaccaaccatcttttcttgtagagattagcaacgtccaatgcagaaatatgtgttgcgtttgtcaggaaagtgaactcacggtcaccctcttcatcatagtaacgaatgagtcggaatgactcgggatatttcttctctgagaggtatccggtcagtttcacttcagcatctgtaagtacatacttaggcatcctacgcttccatttaaccattgtgtatttcaagttcgtcttagctctgacaacgaaaaaggaacctgtcaggtgtatcctatatagttccttaaaagagtcataagccctgtcgaatatataataagcatttggttcataatggattgaacacatcgctgtagagtcgtgcttcgatgctgtggttacagtatagaaggcaggaacttgtgcttcaatgtcatataagacatgagctttgacacctcctttctttcttcggaacttcgcccatggaaatgtggctagacacaacggaatagttgttgaatcaaaagcatacttattccctggaatatccaagatgttggtcgctcgcttttcacaagcttccttcattatatagaatgcgaagtcttcaaagattctgtagtcacgattctgattagcataagcgagggtggctttggctattggattgcgtcccagaccaagatgatattgcttggcttgatgcgcttcaaaagctacaattaagtcgcgaagactctcacgattgctcagttgtccgaacatcatagcaagtaactgattccagcaggtgaattgtttcacgtagcgattaccattatacttgcgaacaaagttattgaattgtgttctgttcataaaagcggtaagttgagcgaatacgtatttatcttggttcataagcggcattcaatttgaccgctaagctacgaattcaaatccgtttcattctaaaatactgcttaagagactgtatttcaacaatttcaaaggcccattaaccaacttttattggacagtagtgaatgcaggtatatctttacatgaaggaagctttaagaatgtaactattgaaggttttaataaacaaatagatatcaatctcaaagcatattattttttgagtaaagcatttcttgaaatgaaactagaagaacataaagatggtaatttattattaatatcatctgaaacaggttccctttatgatgatattccttatggtataataaaagcaggtataaattcactaactggtgctttatcaagaagagtttataaatcaggtattagagttaatgcaatagcccctggagtaactttaacagatatgaccaaagagtacaccaacacaaccagtggcaatttgtctgttaatagtgctagcggaagatattttttacctgatgaagtagcagaagtagcctgctttttactaagtaaagcatctcagtgtatctccggtgaaattattcattgtaacggaggtaatcatctgaaattaaatcgagaaaacattgaatagattttatgcaaccattaatatcaattattgttccctgctataaagtagagaagtatctacctaagtgtattgacagtattattaaacagacctatacaaatctagaaatattccttgtagatgacggctcacctgacaaatgtgggaaaatatgtgatgaatatgcacaaaaagatcctcgtataaaagtaatacacaaaacaaatggaggattgtcagatgcaagaaacgtggctatagataaaatgactggagaatatgtagtttttgtagacagtgacgactatatagcaccaacccatattgaaggcctttatagtatgattcagcgctaccaagctgagataggcataaacacttttataaccttccatgatggaagtgcccctcttccccacccaaaatcaccaaaagagtatgtttatacaggattagaagccactgaaaaaatgttctatcaagaaatgtttgataatagcgcatggggaaaaatgtacaaatccagcttattctataatattcgttatcctaaaggattattatatgaggatcttccaacaacttataaactaatgcttaaggcatcaaaagttgcatataataataatgaaacatactattatttattaagagcagatagtatagaaggatctaaattcactcctgaaaaattgaatagcgcattaaaactaatggagttaatggaacaggacgtaaaatatttacaacccattattaaaagctattactgcagaatggttagtttcattttccatatggttttacaaatgccagaacaatatgagcataaagacttgttttataataaactaaaaaaatatagaagaactgtattgctagataaaaatgcacgaaagaaaacacgtatagcatgcttcttctcatatttaggaataaacactgtaagatatttattcaactatatcaataaaagacgataaatacaacatataataatcaaaatatcaacaatttagtatcttttataacttcagaaccaagctttattatctccttgataattataaaaacacaaaaaaattatttagtaagcgtccaattttgacgtattgcctcaaagaataaaaaatatgaccttcgctgctgtaacaaaaatattaaaagtatgtacagcagcagtgattttgaaaggctgttcatccgctacaaggcggaagcaatgccacaaggtgaatccatccaggatttctgtttgaaaaacaaggtaccctacaatctctttcacaaatggtacaaggatacaagacatcaaatagtaccggtacaagtagaaggacaaccggaaacggaggccaatctccaaaaggaagtgtcctcttctcctactccggaaagaaaggagaatacggaaccctgtcctgtaagaatgatgatagacatccgtatgacaaacggaatacggatacagcaacgaaacttgacctaccgaaacttgaaaagtctgatagagaaactggagggattatgctgaatgtcacaggaatgaacagattttactatctgcgtaattttcatgatatgcgctgtaagtatgaacgggtactatccatcattcaccagcagctgaaccgagagccacaggaagatgaagttttcattgtcatgtccaaggacaggaggaaggtccgtctcttcagctatgacaggcgctcattcagcctctatgagaaacgtttctgtgaaggctacaggttcatgcagttatgccgtcagggagatgaaaccatatacagcatacagtggaaggatgtagttgtgctgttacaaaaccctgtaattaatcaattgaatatcaggtaaataattatataaaacatttgtttatgtcactaaaaatgagtatctttatggtataacaacaggtgacatggacgatcgtgaatttgaaaaaatactggcttcggccgaacaactgaggctccgcgaaaaacaagcggagccttggacagatcgttattccgatatgaattccatggaaaaatcaatgctgcttgacgagcttttcgctttgcgtaaagcggataaggagcgtgaagcaaaacttctggaaaagctggaccggatgacagagcagctgatgaatctgaacgaaagctcacaaatgcaaatgaagcaaaacgaagagctgaaacagatgatagccagtcgggacatcctaatagagaaactccagaaggaaaatgcggccctgaaagagcagaagaaacaggacagaaagaatctgtacggatctaaaagccagaagatttcacgtaagaaaaaggaggaagcaccttctcatgaagagaacaaggatgactttgacgggacttcaggaccttcacccgtttccgcgagtgacgaagatgctctttcaaaagcaccggaaaaagaagaaagaccctatcgtaagggaatgtcttacaagcgtatgaaggcagacaagtcagtatgtcatgactcagacttcagccggctgccgaaagatgccgtaatcatcaagaccttctacaagtattcttaccagcagataagctatatattggagcacaaatatcaggtaatccgttacaagcagtccgacggcaagattcgtgagggatatttcccgaaaaccggggaaccggactacatagacgtagttcccgggactcatgcatcggcggactttctggctcacctggcattcaatcattttgtgctgaatgtcccctactaccgtgaaatgtaccgtctatcggatcataagatgtctctgagccggatgacgctggtcaactggctcgccaaaggagccgcttttacaagcgctctgatagagagactgaaagaccgcgccatggtcaaggactccattctcaactgtgacgagacctggtgcaaggtgaagatgaacagacatttcctgaagaagtatgtctggtgcctggtaaacaaggaacagaaaatagtaatctactgttatgaggacggttccagaggacgtaaggttctcaaggaaatcctcaaggacaggcaggtaaaggcgctgcagtcggacggttacaacgtttatatgtacatcgacaaagaactggtagacacggaacatctctgctgcctggctcatgcacgtgctaaatttgtctatgcatatgaacagggcgatgatcccgatgctaaatatctgatagactgtttcggagaactttaccggctggaagatacttataaattaagcgggctttcagcacaggagataaccagctgccggcactcattgcggaccaaggaaattatagggcgcataagaagcaagctggatgtgctgctgtctccgactcatcctccccgtggagaactcatggacaaggctgtgaattatcttcaggttttctggaaacagctctttgcctatctgaacgatgggcggtatgacatagacaattcaatagcagaacgtttcatccgtccgttggcgggtgagcgcaagaactcgctgttttttgttggtagccgcatggcaaatgtatcggcggcctatcatacgctgctctcaacatgccgaatgaacgggctgtctgctctggaatatctcaagaaattcttccacgaaattgtcaaagggagaaaggattatgaaaatctcctgcccatgactatcggaattaatactaacaaatattaataatcaagttcaatttttgatttttttaagtaagcgtccaattttgacgtattgcctcaaagaataaaaaatatgaccttcgctgctgtaacaaaaatattaaaagtatgtacagcagcagtgattttgaaaggctgttcatccgctacaaggcggaagcaatgccacaaggtgaatccatccaggatttctgtttgaaaaacaaggtaccctacaatctctttcataaatggtacaaggatacaagacatcaaatagtaccggtacaagtagaaggacaaccggaaatggatacacaatcctcaaaggaagtgtcctcttctcctactctggaaagaaaggagaatacggaaccctgtcctataaggatgatgatagacatccgtatgacaaacggaatacggatacagcaacgaaacttgacctaccggaacttgagaagtctgatagagaaactggagggattatgctgaatgtcacaggaatgaacagattttactatctgcgtaattttcacgatatgcgctgtaagtatgaacgggtactatccatcattcatcagcagctgaaccgcgagccacaggaagatgaagttttcattgtcatgtccaaggacaggaggaaagtccgtctcttcagctatgacaggcgctcgttcagcctctatgagaaacgtttctgtgaaggttacaggttcatgcagttatgccgtcagggagatgaaaccatatacagcatacagtggaaggatgtagttgtgctgttacagaatcctgtaattaatcaattgaatatcaggtaaataattatataaaacatttgtttatgtcactgaaaatgagtatctttatggtataacaacaggtgacatggacgatcgtgaatttgaaaaaatactggcttcggccgaacaactgaggcttcgcgaaaaacaagcggagccttggacagatcgttattccgatatgaattccatggaaaaatcaatgctgcttgacgagctttttgccctgcgtaaagcggataaggaagaaagggacagacttctggaaaagctggaccgaatgacagagcagctgatgaatctgaacgaaagctcacaagcgcaagtcaaggttattgatgggctgaaacagatgatagccagtcgggacatcctaatagagaaactccagaaggaaaatgcagccctgaaagagcagaagaaacaggacagaaagaatctgtacgggtctaaaagccagaagatttcacgcaagaaaaaggaggaagcaccttctcatgaagagaacaaggatgactttgacgggacttcaggaccttcatccgtctccgcaagtgacgaagatgctctttcacaagcaccggagaaaaaagaggaaagaccctatcgtaaggggatgtcttacaggcgtatgaaggcagacaagtcagtatgtcatgactcagacttcagccggctgccgaaagatgccgtaatcatcaagaccttctacaagtattcttaccagcagataagctatatattggagcacaaatatcaggtaatccgttacaagcagtccgacggcaagattcgtgagggatatttcccgaaagccggagaaccggactacatagacgtagttcccgggactcatgcatcggcggactttctggctcacctggcattcaatcattttgtgctgaatgtcccctactaccgtgaaatgtaccgtctatcggatcataagatgtctctgagccggatgacgctggtcaactggctcgccaaaggagccgcttttacaagcgctctgatagagagactgaaagaccgcgccatggtcaaggactccattgtcaactgtgacgagacctggtgcaaggtgaagatgaacagacatttcttgaagaaatatgtctggtgcctggtaaacaaggaacagaaaatagtaatctactgttatgaggacggttccagaggacgaaaggttctcaagggaatcctcaaggacaggcaggtaaaggcactgcagtcggacggttacaacgtttatatgtacatcgataaagaactggtagacacggaacatctctgttgtctggctcatgcacgtgccaaatttgtctatgcatatgaacagggcgatgatcccgatgctaaatatctgatagactgtttcggagagctttaccggctggaagatacttataaattaagcgggctttcagcacaggagataaccagctgccgacactcattgcgaaccaaggaaattatagggcgcataagaagcaagctggatgtgctgctgtctccgactcatcctccccgtggagaactcatggacaaggctgtgaattatcttcaggttttctggaaacagctctttgcctatctgaacgatgggcggtatgacatagacaattcaatagcagaacgtttcatccgtccactggcgggtgaacgcaagaactcgctgttctttgttggcagccgcatggcaaatgtatcggcagcctaccatacactgctgtcaacatgccgaatgaacggactgtctgctctggaatatctcaagaaattcttccacgaaattgtcaaagggagaaaggattatgaaaatctcctgcctatgacaattggaattaatactaataaatattaataatcacgttcaatttttgatttttttaataggaaaccgctaaaaagcggctttccctatactacacgtcaaaattggacgctaactttttttaataggaaaccgctgaaaagcggctttccctatactacacgtcaaaattggacgctaacaattatttaaatatccgattttaaatcattttctaaatcatgaaagtactccacattgggcaactaataggtggactggatatttatatccgtaacactattacttatgccaacaagtcctttgattttgtgattgcacacggtatatctgataaaaatcagccaatcataaaagatggaaagaaaataaaagaatataatattagtttatatcgagaactaaaccccatcaaagacataaaaggattatggcaggttctgaaaataatccgaaaagaaaagccagatatcattcattgccatagtgctaaaggaggttttatcggcaggattgcaggattcttaactcataccaaaacattctatactccacacgctttttcctttctatcaacacaaagcaaactaaaaaaatcaatattcttattcctagaacatttagctaaattagattcatatcttttagcttgttctagttcggaaaaagatttgggtataagccttgtgcattattcttctaaaaaagcacttgtttggagcaattcagtacctgatgcaaaaaatgttattccaccaaaagaaataccaacatcgccttacatctgttatataggaagaccttcttatcaaaaaaatccattttttcttgttaacgttataagagaagtccacaaaaaacatccagacattttattttacattctgggagtaggatattattctcctgatttggaaactatgcaacagatgataaaagactatcaactggataatacaataatcctattaccatggctaaatcacgatgaaactatgggatatgtaaaaaatgcattattttatctaactccctccagatatgaaggattacctttagctgtaattgaggctatgtcacttggaaaatgtatcgtagcttcagatgttctagggaataaagattgcgtaaaaaataattataatggatatcttcttcccttaaaagaagatacatttgccaataaaattaatcaattaatcgaatctcctgaaataagaaaaaaattcgagtttaattctagaaaatactttgaagaaaattttcttattgacaatagaatttgttatttggaaaaaatatatcaagaaaaaatcaataattaagaatctttattacatttctttacgaccttaataaaaagggaatcacattattatagcaggcaatgtaggagaatatttgtaagcattgtatattaattaaacgttgtacttttgtataaattttcaacatcaaagtgtggaataagaccgacgtaagcttagtcatttagattgtatcggatgttcagcccccacacttttacatcagaatccggatagttcattgggcagttagaccccgcatttgcaatgatggctaaagatgtatagatgttgcgttgtaattataaaaaccattagcttatgacctacgttggaattgatgttagtaagttaacattcgtggttgcttattcttctgcaaaaagcagtaaaaccaaaacctttaagaatacagctaaaggtattcgtgagtttataaaaacgatatcagttgatgaacatcattgtgttatggaagcaacaggcaattatagtacattgcttgtatatatgctttccgagtttggttttacagtaagcctggagaaccctctgaagataaaaaatttctccaaagtcatgctttcagtcataaagtctgacgagattgatgcacgtcttatagcactatacggtgagaagatgcaaccatctccatacagaatgcgcagcgattcaattttagttctcaaacaaaaacgtactgtcctacgccagctaaagaagcagttagtagcaacaagcaacctgaaaggttctatggaggttcttccaatttatgactctaaatgcaagaaaacaatagagaaaacgattgcttttctgggaaaacaaatcaaatatatggaagaagaactggcttcattagctaatgatgaattcaagaaacagatggatttactcacttccataaaaggtatcggtgtaacactagctgcggctttaattgtggcaactggtggctttacatactttgataatgcaaaacaacttacgcgttatcttggcttatcaccaacatatcaacagtcaggaacatctgtcaactttaaaggtcacataaacagaaatggcgatccaattcttcgaagtcaactatatgtggcagcattctcatcacttaggtgcaatacagaatgtaaagcatgttttgaccgtctacgatctaaaggtaaacctggtaaagtagctgttgttgctgtcgccaataaattggtaagacaggcctttgcagttgttacacaagataagccatatgttgatggatttatatcagtaaaaccataatcactcctgcggagggagcgccatgcggcaagggactgagcagtcaggcccgacgagttttcattatacatatgcataaacatacttataattgttaaatatattcaagtttttattatagttcatccaattttgacgtattgcctcaaagaataaaaaatatgaccttcgctactgtaacaaaaatattaaaagtatgtacagcagcagtgattttgaaaggctgttcatccgctacaaggcggaagcaatgccacaaggtgaatccatccaggatttctgtttgaaaaacaaggtaccctacaatctctttcataaatggtacaaggatacaagacatcaaatagtaccggtacaggtccaaggacaaccggaaatggatggcgaaaacggagcatacccacccacttagaacggcataatccacccacaattattgctaaaatgggcttgaaaagggcataaaaaacggagcatatccgttcatttttgctaaaaaatgcccaaagtcgctcaaaaaacggagcatatccgttcagtggtttgtgattacgataaaatatccgttttactatacaaaaatcggagtatatccgttcagtgatgggaatgtaataatacaataatcagttgtttacattcggaaaacggagcatatccgttcactttctcatagaaacgacgatgcctgcataaaaaacggggcatgtccgttcactttccactctttcccgtatcttgtatgcagaatataatcttcatacaatacgactatggcaggaaaaagtaagaatatgagccagatcaaacaacttcttctattaaagaagaatggagtctccaaccgcaaggctgccgatataatcggcatgaacaaggagacagtgaacaactacatgaacaaggtcagcgctgacagcctgagccttgatgaacttatcaggctggacgatcccattcttgagcaccgtctcaagggcggcaatcctgcatatagtgacaaacgctttgaaacattcaaaacccttcttccatatcttcaggaggagatgaagcgcaagcatgtcacgctgaagcttctttgggaggaataccgtaatgagcatcctgacaaccactacagcctgacacagttccgttttcattacaaacagaacacagaggccggaaaggaatcgccatctaccatacttgctgacatgcgtactggcggtgaaaagcttttcctcgattttgccggtgataccatgggatacgttgatatggaaaccggtgaggtcgtccagtgccaggctttcgtagccactctgcctgcaagcgactacggttatatcctcttcgtacgttcacaacgcacggaagactttgtatatgccataacacagtgcctgaaacatcttggcggcgtaccaaagatgcttgtccctgacaaccttaaagctgccgttgtcaagacagacagatatgagccttcgcttaaccgtgtaatggaggatatggccaatcattatggcacggtcatcataccggcacgtcccgcacacccaaaagataaaagcaacgtggaagggaccgtgaggcttgtctatatgcgtgtgtttgccgaactccgcaatgaaaccttccattcactggaagagcttaaccgggcagcctcgctcaaaatgaaagcgcacaaccagaaacgcatgcagaagcatccttacacgcgtgaggaacggttccttgccgtagacaggccaaatcttatgccgctgcctgacagggattttgagattgtgtcatataccgatttgaaggtgtcaaccaactgctgtatctatctcggacgtgaccagcactattatacagtgccgtatcagtatatatccaaaactgcacatgttgcatatacacgcacactggtaaaagtatatgtggacggtgaacttgtagccactcacatacgtgattacaacaggggaaagtatactattgtaaaggagcatcttgcaagcaactcccgggaatacagaggaatgagtgcaaaatcatacatagagcgtgccgagcgtgcatccggcatacttggagatgtaatccgccgcatattttattcttccacaatgcctccggagactcattacaagacctgcgacgggcttctaaacctgcaaaggagcagtgatccggccgttttccagaaagcctgcgagacagccctgaacgtagacagatgcagttaccgctttatacgctcactggtggaaagcaagtgtgccggtgtggggcagcctacatcttcctttgctcctccgcaacactgtaatatccgtgggaaatcacagttcaaatgacagacttctaacactcaaaaccaataacgatggatgaaattatcaatgctctaagaaaccttaagatgcccggaatggcacattactgggctacgatgcaggagacgcgacaggcagagtcgctctccttgaaggacggcctgcaactgcttatacaggccgaactggataaccggaatcaaagccggaatgcccgtctgataaaaaaagcacacttccgttatcacgcttccataagtgaagttatatatgacagcaagcgtggcgtagacaagcagaaagtgcttaatcttgccacttgtgactatgtgaaaaacggggtgtccatacttattacgggagcttccggtacaggtaaaagctggttgggtacagcgtttggtcatcaggcctgcatgaacggacataaggttgcctattataacctgtacaggctcttcgaggaaataagccttgcccgcatatccagtaccctgcatcgtttcttcgccaggttggcacagactgatctgcttatactggacgacttcggtatgaaagttcttgacggacaacagctgcttgactttatggagattatagaagaccgacatggacagaaagctactatcatcatatcacaactgccggttgctaactggtacgatgtgatgaaaggcaacacgactgcggctgatgcaatattagacaggctggtgcacacaagtgtgcgcttcgagttagaaggcagcagtatgcgtcaaaaaaaacatccaaaatataacattacagacgaaaatcaataaatttgcatcgccataggtttagaggatgaaaagtgaacggatatcaccgttttgggtgaacggatatcaaccgttttcagcaaatggatacacaatcctcaaaggaagtgtcctcttctcctactccggaaagaaaggagaatacggaaccctgtcctgtaaggatgatgatagacatccgtatgacaaacggaataaggatacagcaacgaaacttgacctaccggaacttgaaaagtctgatagagaaactggagggactatgctgaatgttacaggaatgaacagattttactatctgcgtaattttcatgatatgcgctgtaagtatgaacgggtactatccatcattcaccagcagctgaaccgagagccacaggaagatgaagttttcattgtcatgtccaaggacaggaggaaagtccgtctcttcagctatgacaggcgctcgttcagcctctatgagaaacgtttctgtgaaggttacaggttcatgcagttatgccgtcagggagatgaaaccatatacagcatacagtggaaggatgtagttgtgctgttacagaatcctgtaattaatcaattgaatatcaggtaaataattatataaaacatttgtttatgtcactgaaaatgagtatctttatggtataacaacaggtgacatggacgatcgtgaatttgaaaaaatactggcttcggccgaacaactgaggctccgcgagaaacaagcggagccttggacagatcgttattccgatatgaattccatggaaaaatcaatgctgcttgacgagcttttcgctctgcgtaaagcggataaggaagaaagggacaggcttctggaaaagctggaccgaatgacagagcagctgatgaatctgaacgaaagctcacaacgcttactgaagcaaaatgaggaacagcagaagataatctttgatttaaataaattggttgagaagcttcagaaggaaaatgcggccctgaaagagcagaagaaacaggacagaaagaatctgtacgggtctaaaagccagaagatttcacgcaagaaaaaggaggaagcaccttctcatgaagagaacaaggatgactttgacggaacttccggaccttcatccgtttccgcaagtgacgaaaatgctctttcacaagcaccggagaaaaaagaggaaagaccctatcgtaaggggatgtcttacaggcgtatgaaggccgacaagtcagtatgtcacgattcagacttcagccggctgccgaaagatgccgtaatcatcaagaccttctacaagtattcttaccagcagataagctatatattggagcacaaatatcaggtaatccgttacaagcagtccgacggcaagattcgtgagggatatttcccgaaagccggagaaccggactacatagacgtagttcccgggactcatgcatcggcggactttctggctcacctggcattcaatcattttgtgctgaatgtcccctactaccgtgaaatgtaccgtctatcggatcataagatgtctctgagccggatgacgctggtcaactggctcgccaaaggagccgcttttacaagcgctctgatagagagactgaaagaccgcgccatggtcaaggactccattgtcaactgtgacgagacctggtgcaaggtgaagatgaacagacatttcttgaagaaatatgtctggtgcctggtaaacaaggaacagaaaatagtaatctactgttatgaggacggttccagaggacgtaaggttctcaagggaatcctcaaggaccggcaggtaaaggcgctgcagtcggacggttacaacgtttatatgtacatcgataaagaactggtagacacggaacatctctgttgtctggctcatgcacgtgccaaatttgtctatgcatatgaacagggcgatgatcccgatgcaaaatatctaatagactgtttcggagagctttaccggctggaagatacttataaattaagcgggctttcagcacaggagataacccgctgccgacactcattgcggaccaaggaaattatagggcgcataagaagcaagctggatgtgctgctgtctccgactcatcctccccgtggagaactcatggacaaggctgtgaactatcttcaggttttctggaaacagctctttgcctatctgaacgatgggcggtatgacatagacaattcaatagcagaacgtttcatccgtccgctggcgggggagcgcaagaactcgctgttctttgttggtagccgcatggcaaatgtatcggcggcctatcatacgctgctctcaacatgccgaatgaacgggctgtctgctctggaatatctcaagaaattcttccacgaaattgtcaaagggagaaaggattatgaaaatctgctgcccatgactatcggaattaatactaacaaatattaataatcaagttcaatttttgatttttttaataggaaaccgctgaaaagcggctttccctatactacacgtcaaaattggacgctaacaatcttccctcgtattaggattatttacttaatatttgatttatactgattttaacggaatactaataacttatattttatacgaatagttatgaaaatcttacaaacaataaattatccagcttggataaaagtttcagagggtaagcaaccctctcatcatctttttggaatagaaggacatattttaaaatatgaaaaaagaaaaaatcataaatatagaggatatctaaaagatggaggatatgttgattttttattagtttcggataaagcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattggataaaggaaaactaaaaaatattttattctgtataacattatattttaagctttttaaatatgatgtcgtatttgacagtctttgtgttgtaactaaatacttaggtattctctttagattttatcgtccatgtaaattaatatctataatccaccatccaccatttaacaaaatattaaaattaacaagacctgatgcttgcattttcttttctgaaaaatacaaaaatatggcagatgaaataaatcctcaaaacaagaacaagcattttgctctaaaatggcaaccagacaaaaaatggtataaagagaaatcaacagacataaaagaaaatgaaaaaaaatacatgtttatagataatggtaaaacttttagagatcatgaaataatgactgaagctatatataaaattggagcaaaagctgtacttattaatcaacgagaagcaaaacctcaaaactatatagaaggaaaaaatcttgattttatcatatcagaaaagcctgatgacgaattattacttaaatatcttcttaaaagtaaatgcatattaattcctgcaaaaaaagatccaaataaaaagctattaggacctattggaataacttcttttatggatgcaatagctctaaatatgccagttatatgctctaataatttatgcttttctgacgatgtcagtaaatttacattaggtataacttatccagccggcgataaaaaagctctttaccaagcattagaaaaaatgtatagagatactcagttttataacacttgttgcaataacatgaaaaattatgctaaagatcaagatatatctttttatgaaaatgaaatttggaatataatatatagttgcacaaaaagtaaaaaatatcaataaaaaatatactgtttaaagacacaaaaacacgatattgctaactgctgtctttaaacgatgtatcacataaaacctttaaattatattaataaattattacttataatcattttttagacttcagcatgcaaaatcatatagtaatcatggcaggcggtataggaagccgtttctggcccatgagcacccccgaataccctaaacagttcatcgacgtgatgggcgtaggaaaatcgttgattcagctcacggtggagcgtttcaaggatatctgcccgaaagaaaatttctggatagtgacctcggaaaagtatgtagacatcgtaaaggagcagcttccgcaggtgccggagcagcatatcctggcggaaccggaggcgaggaatacggcaccgtgcatcgcgtatgcgtgctggaagatccgaaaggagttcccgcaggcgaacatcgtagtgactccctcggatgcgctggtaattgatacgacggaatttgcccgctgcattaccgtggcactggagaaaacggcggtctcacatgctattgtgaccttgggaatgaagcctacccgaccggaaacaggctacgggtacatcgcggctcaaggtgaagccgacgaaaaaggtatctacaaagtggaagcattcaaggagaaaccggacgtagaaacggcgaagatgtatcttgcagcgggaaattatttctggaacgcagggatatttgtgtggaatgtggaaacgattaccaatgctctacgcaggtacgctccgcagattgcgggagtgatggacgagctggagcctaccttgtttaccgacaaagaagcggaagagctgaagcggctcttccctacttgcgagaagatttccatcgactatgcggtgatggaaaaggcggaggatatctttgtgctgccggctgaattcggatggagcgacttgggtagctggggttcgctgcgcaccttgctgccgcaagatgaagcgggcaatgccaaggttggcagccgggtggatatgtacaactgccggaactgtgtggtgcatgcggcggagcacagacaggtggtgctggaaggtctggagggctacatcgtagcggagaaagacggacgtctgctggtgtgccgactgagtgaggagcagcgtatcaaggattttgcagcggggaagtaaccgggaatcaccacgattcctgctactgaaagattttgattctccattgtttttttaatccttttatctgtaagcgtccaattttgacgtattgcctcaaagaataaaaaatatgaccttcgctgctgtaacaaaaatattaaaagtatgtacagcagcagtgattttgaaaggctgttcatccgctacaaggcggaagcaatgccacaaggtgaatccatccaggatttctgtttgaaaaacaaggtaccctacaatctctttcataaatggtacaaggatacaagacatcaaatagtaccggtacaagtagaaggacaaccggaaatggatacacaatcctcaaaggaagtgtcctcttctcctactctggaaagaaaggagaatacggaaccctgtcctataaggatgatgatagacatccgtatgacaaacggaatacggatacagcaacgaaacttgacctaccggaacttgagaagtctgatagagaaactggagggattatgctgaatgtcacaggaatgaacagattttactatctgcgtaattttcacgatatgcgctgtaagtatgaacgggtactatccatcattcatcagcagctgaaccgcgagccacaggaagatgaagttttcattgtcatgtccaaggacaggaggaaagtccgtctcttcagctatgacaggcgctcgttcagcctctatgagaaacgtttctgtgaaggttacaggttcatgcagttatgccgtcagggagatgaaaccatatacagcatacagtggaaggatgtagttgtgctgttacagaatcctgtaattaatcaattgaatatcaggtaaataattatataaaacatttgtttatgtcactgaaaatgagtatctttatggtataacaacaggtgacatggacgatcgtgaatttgaaaaaatactggcttcggccgaacaactgaggcttcgcgaaaaacaagcggagccttggacagatcgttattccgatatgaattccatggaaaaatcaatgctgcttgacgagctttttgccctgcgtaaagcggataaggaagaaagggacagacttctggaaaagctggaccgaatgacagagcagctgatgaatctgaacgaaagctcacaagcgcaagtcaaggttattgatgggctgaaacagatgatagccagtcgggacatcctaatagagaaactccagaaggaaaatgcagccctgaaagagcagaagaaacaggacagaaagaatctgtacgggtctaaaagccagaagatttcacgcaagaaaaaggaggaagcaccttctcatgaagagaacaaggatgactttgacgggacttcaggaccttcatccgtctccgcaagtgacgaagatgctctttcacaagcaccggagaaaaaagaggaaagaccctatcgtaaggggatgtcttacaggcgtatgaaggcagacaagtcagtatgtcatgactcagacttcagccggctgccgaaagatgccgtaatcatcaagaccttctacaagtattcttaccagcagataagctatatattggagcacaaatatcaggtaatccgttacaagcagtccgacggcaagattcgtgagggatatttcccgaaagccggagaaccggactacatagacgtagttcccgggactcatgcatcggcggactttctggctcacctggcattcaatcattttgtgctgaatgtcccctactaccgtgaaatgtaccgtctatcggatcataagatgtctctgagccggatgacgctggtcaactggctcgccaaaggagccgcttttacaagcgctctgatagagagactgaaagaccgcgccatggtcaaggactccattgtcaactgtgacgagacctggtgcaaggtgaagatgaacagacatttcttgaagaaatatgtctggtgcctggtaaacaaggaacagaaaatagtaatctactgttatgaggacggttccagaggacgaaaggttctcaagggaatcctcaaggacaggcaggtaaaggcactgcagtcggacggttacaacgtttatatgtacatcgataaagaactggtagacacggaacatctctgttgtctggctcatgcacgtgccaaatttgtctatgcatatgaacagggcgatgatcccgatgctaaatatctgatagactgtttcggagagctttaccggctggaagatacttataaattaagcgggctttcagcacaggagataaccagctgccgacactcattgcgaaccaaggaaattatagggcgcataagaagcaagctggatgtgctgctgtctccgactcatcctccccgtggagaactcatggacaaggctgtgaattatcttcaggttttctggaaacagctctttgcctatctgaacgatgggcggtatgacatagacaattcaatagcagaacgtttcatccgtccactggcgggtgaacgcaagaactcgctgttctttgttggcagccgcatggcaaatgtatcggcagcctaccatacactgctgtcaacatgccgaatgaacggactgtctgctctggaatatctcaagaaattcttccacgaaattgtcaaagggagaaaggattatgaaaatctcctgcctatgacaattggaattaatactaataaatattaataatcacgttcaatttttgatttttttaataggaaaccgctaaaaagcggctttccctatactacacgtcaaaattggacgctaaccttttatcttattcattcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgttattttattcctacatttgcgatacacatttattgagaaactataaaaactataaaaacatggccaaaataacaaaagaagccgctttgctctatcactcacagggcaagcccggcaaaatagaggtagttcctaccaaaccctatcaaacgcagagagatttatcgctggcatattccccgggagttgccgaaccttgtctcgaaatccagaaaaatcctgacacagcttacgattatacagccaaggggaacctggttgccgttatatcgaacggtacggctgtactgggcttaggcgacataggtgccatgagtggaaagcctgtaatggaaggtaaaggactgctctttaagatttatgcaggtatcgatgtattcgatattgaagttaacgagaaagatccggataaatttatcgaagcggtgaaagccattgctccgactttcggaggtatcaacctggaagatataaaggctcctgaatgcttcaaaatagaacagcgcctgaaagaggagctcgacattccggtcatgcacgacgaccagcatggtacagccatcatctcgagtgccggactgctcaacgcgctggaggtagcaggaaagaagatagaagatgtgaagattgtggtaaacggtgccggtgcctcggctgtatcgtgtaccaagctatacgtttcactgggtgcccgtctggaaaacatcgtcatgctggacagcaaaggggtaatttccaaacagcgtacagacctgaacgaacagaagaaattcttcgcgaccgaccgtacggatgtgcatacactggcagaagccatcaagggagctgatgtattccttggcttgtcgagaggcaacgtactgactcaggacatggtacgaagtatggccgatcatccgattgtattcgcactggccaatcctactccggaaatttcgtatgaagatgccatggcgtcacgtcccgacgtactgatgtcaaccggccgttccgactatccgaaccagattaataacgttatcggattcccgtatatcttccgcggtgcactggatacccgtgccacagctatcaacgaagaaatgaaactggctgccgtacgcgccattgccggacttgccaagaaaccagttccggatgtagtgaatgaggcataccatgtaaacaacctgactttcggtccggaatatttcattccgaaaccggtcgatccccgactgattacagaagtttccatggcggtagcgaaggctgcaatggaatcgggtgtagcacgcaagcagattaccgactgggacgcatacaagaatcacctgcgcgaactgatgggacaggaaaacaagctgacccgccagttgtacgaaacagcccgccgctgcccgcagcgcgttgtctttgccgaaggtactcaccccaatatgctgaaagcggctgtagaagcgaaggcagaaggtatctgtaacccgattctgctgggcaacgaagaaagaatagccaaactggccaaagaacttgacctgaacctggaaggcattgaaatcgtcaacctccgtcacgaccgtgaggctggacgccgcgaacgctatgcacgcatcttgtgtgaaaagcgtgcccgtgagggagcgaacttcgcagaggcaaacgacaagatgttcgaacgcaactacttcggtatgatgatggtagaaaccggtgaagctgatgcattcgtaaccggtctgtacaccaaatactcgaataccatcaaggtggccaaggaagtgatcggcatacagccgggatacaaccacttcggtaccatgcacatcctcaactcgaagaaaggaacatatttcattgccgataccctgatcaaccgtcatccggataccgatacgctgattgacatcgccaaactgtctgtcaaggcagtacgtttcttcaatcaggagccagtgatagccatgctttcgtactccaacttcggttccgatacggaaggaagtccggcaaaggtacacgaagccatcagctacatgcaccgtgaatatccggaactggccatcgacggagaaatgcaggttaaatttgccttgaacaatgcactgcgcgacgaaaaatatccgttcacacgtctgaaaggcaaagaagtcaatacgctggtattcccgaacctgagttctgccaatgccacttatcagctcattcagagcatgagtgaaacagaagtcatcggcccgatccagatgggactgaacaaaccgattcactttacagacatcgaaagctctgtacgtgacatcgtcaatatcacagccattgcctgcatcgatgccattgtagacaagaaaaagaaacaatgctaatttctgaataaacgaaaagctggaaataaagagtgaagaaacatctctggcaaagagatactttattctttattttcagcttttttatttgataaaccttacctgtttaaaagccatgagaaaaccacttaccaaaacccaatgtgtcattcttaccctgttttgggcagcactttgctttgtaattctgacctccaccccacgcattgacggccccctcgtcgtaatgattcttatttcaggagctcttgtatttattcctgtaatcaaatcattaaggaatgacaaacaataactatttacacatatttaaattacaaattcaatcatttttaaggctttttcttgtttttatttatcaaggtgttgcgcaaataaaaaattatctatatttttgtcacatacaaagaattcaaacaatccaataattaatatagataatttatgaatgcagctaaagtactggaagatctgaaaagaagatttccaaatgaacctgaatatcatcaggcagtagaagaagtgctcggcactattgaagaagaatacaacaaacacccggaattcgacaaagtaaatctgattgaacgtttgtgtattccagatagagtttatcagttccgtgtaacctggatggacgataaaggcaatatccagaccaatatgggttaccgcgttcagcacaacaacgctatcggcccttataaaggtggtattcgttttcacagttcagtaaacttgggaatcttgaagttccttgctttcgagcagacattcaaaaactcactgaccactcttccaatgggtggcggtaaaggtggttcagacttctctccgcgtggcaaatcgaatgcggaagtcatgcgtttctgtcaggcatttatgctggaactgtggcgtcacatcggtcctgaaacagacgttcctgccggagatatcggtgtaggaggtcgtgaagtaggctatatgttcggtatgtacaagaagctggctcacgaatttaccggtgtactgaccggaaaaggacgtgaattcggtggttcgctgattcgtccggaagcaacaggttacggaaacatctacttcctgctggaaatgctgaaaacacgtaacatcgaactgaaaggcaagacttgtctggtatccggttcaggcaacgtagctcaatataccgtagagaaactgattcaattgggagctaaggttgtaaccatgtccgattctgacggttacatctacgatccggacggtatcgaccgcgaaaagctggattacatcatggaactgaagaacttgtaccgtggacgtatccgcgaatacgcagaaaaatacggctgcaaatatgtagcaggcgcacgtccgtggaatgaaaaggctgatatcgcccttccttctgcaactcagaatgaaatcaacggcgacgatgccagagcgctgattgccaacggtgtcatcgcagtttctgaaggtgccaacatgccatctactcctgaagcaatccgcgtattccaggaagctaagattctgtacgctccgggtaaagctgccaacgcaggtggtgtatctgtatcgggcctggaaatgactcagaactctatcaagttgagctggagccaggaagaagtggacgaaaagttgaagagcatcatgaagaacattcacgaagcttgtgtacagtacggtacagaaccggacggctatattaactatgtgaagggtgcgaacgtggcaggtttcatgaaggtagccaaggccatgatggctcagggtattgtctaaccgaaaaaaattaagggcaggcatcaattacaatagtcgatgcctgcccttcacattctccgaaaaataaaattcttatattttattcagcaatcaatttaaagtcgtctacaatcaatttgctacccggagctccccagaacttatcaccatccttacttgcagaacagattattgccatacgatattttttatcagcgctatattctttcttccattcaagaggcaactcaaattctttccattcatcctgcttgccacctgtcaactgagcaatagcggcaatacgactagatgtatagatatttttctctgaatcaggatctccagtcagacaatcagaccatccttctgtatcaaattcatcggtttcatatacaacaatactaatcatgaattcatcggtctttgtttcatccaatacagcttcatggcaatgctgagcatacggttgttcgtttactacataaaattctgcacccggagtatacttataccaacctttcaaagaaacagcctttgctgaatacggaataccaaactttgtactatttagtgtactagacatatccgtaataaaagaacccaagaacaaagaacctgttgttaccttaggaacttttgcaataatcatatcttttcctttcgtatcgatagaagtaattgaaacagcattttcaccagaatgtgcatcatttgtagcctcaacaacataactatcagccaaaccgaatgcttttaacaactgagcaccggaattgctggagcaccatccttccggattataaaaaatcatatcgggtgtcagaccttctgtatcttctacacctgctacccagttttcaaaatcataagaagtaacattaccataaacagaagctgtatatgtaacctttgtaccattttcagcagttacggtataagttacggttttaccgtttgaaaaatcctgaacagctccgctcgctggagttacagttgctttttcagaaacctcaatagtcggcatcagttttgacaaatcatcgctagtagcatcagcacttacagcaaacttaatggtctttgccgtttcatcaactaccggctgttccaatacgactgcattggctgcagacacttcctgatcgaaaacaaaagaaagaatcttagcttcactgctttcagaaccagtcaacttagtacctgtataaacaacctttacagtttgttttacgctatccagagaagcagctatatccatattgatagtcagtttatctccttcaaaagtaccttcagcatctacgtcagctgttagtatagcagcattaacttttgttgttccagtgaaagtatatttatcaccacttccacttaactgacattcgttcaaattgatatcaccaattgatatacccatgaaagaaaaatcagatattgacagacttacagtagactcaccagccttggttactgatactaactgattttcaacagtgggcaaatttgctgcatccaccatcacatccagattacccttatagttacctgttacatcagctgctgcaggtgtaattacacccgattcatcatcgctgctacaagcagtaaatgtacccattgtacataatgcagcgaataagcataaaaacaaattctttttcatctattaattaagttaagttatttttagcggttgcaaagtaactaccttttagtgtattctacaaggtctaatcttattatttttgttcttttttttaatatttgattcaccctacatacctaaataattaatttacaaaacttaacaagtattttcgcgaatagcataatcgtctatatcctaaaaaccgttacctttgcaaaaaatcaatacatatggaaaaagaactacccaagatagatttgccggaggaatggattgtaggaaccggaatcagcaaggaactactcagcctatataccaattttccctgccggataaaatcggaaatttttgttctatgtttgggaggagaagtggaagcttcggtcaatttgaataaaattactgtaaggaaaaatgattttgtatctatcatgccaggaaccatccttcagatacatagtgtaaaaggagaactggagttatattttggcggattttcttcaaagtatgtagaacaagccaatttaaacccttctaccatcaacacattatacatacccttgggacgtcctctcatcactcttcgtccagagggtgctacactgctgaaagattacttttgtttcctcatcaaactatatgaattctttaatgaaaatacacgcaaacttatcacgtctcatttatatagtgacattcatacgggtatagctgctatgtacaacaaccgggcaaacgataataaaagcagtctttcgaaaagtgagatattgtgtaagaatttcacccagctagtgatgcaaaattacaacaagacacgcaatgtatcttggtatgcagaaaaattaggtatcactcatacacatctttgtacaactgtgaaacaagccacgggaaatacatgtatggaaatcatctcacggatggtcatcatggatgcaaaatcacaattaaaatcaacaaaattgtctattcaagaaatttccgactcgctgaattttgccaatatgtcctttttcggaaaatatttcaaacgctatgtcggtatgagtccgctggaatacagaaacaacggataagtacaaaaaagaacaggcagaaagaacaaagaacatatttgccaaaggcttcttcgtgtaatctttctgcctgtttttctgcaatatagtgcgattaagccatgcaaaccacacctattttcttttttccatccatcttgacagtcaaaggcttgtcgaaatgaacccaccgcaagaattttgtttcttctacggccggcatgctgttcagcaactcctgattgtacaagccgtcgttcatgtaagcattgatcgtaaaataccctactccgaaagaggtcaggttctggaagaagtgtgttccctgactcggatcgacacgataattggtcagccccgcttccacgatgacgcgggccgccgatatgttcggccattttacgggaatacccaaccatgtatcgctgcttccccagcgtcccggtccgactaatatgtaatgcttgccttcgtcgaggaaacgcttgttcagcttttctatatcataagcaatcaactgattattggacgctgaatatccgtcggtcttcacataaatcacatcctgaatatcatccataatcccctgccccaacgaattgacgctcttgagcagaagctgatcttcgggtatagtattcaagtcctcattcaaatctgccttcatatccaccatcggacgtatctgcaacagataaaaaacaccctttttctctttcgcatccagatttacagcaaactctatctccacaggacgacgcatttcgccttgtccgtacttctgagcaagctggagaatacgtgccagcggaaaaacatcgtgctgaagaatattggcaaaagtgatgaccttacggcctcccggataaataccatcgcgtataaccatatcatacggatcgtaggtagaggcgatgtaagtcaaagctccatcgttctcggcttcctttaccggaagtttcaacaagttaaagccgtcgtcgagcgaaaagttctgtcccagattcttcaggtcgagcgcatagaaacgtgtctgtgtttcgcgcaaagccatctccatctcgctggtctgaagcactttatccggatgataaggacaaacccttaacgtcagtcctccgtcgacgatatattttccgagtcccagtgccaggctgaccgttccttcttctgccagttcgtcgttgatgggataataattgatggaacgcgccacccccgaaatagaaggataaaaacggtcgccatactgtgtacccaccacttcctgaagaatcaccgccatcttttcctgatcgatcacgttgctggtagcctgcatatacgccttactatccttataatataccgaagcatagactccctttattgaatcgctcaacatgcgaagcatttcatatttgtctgtcagataaggtatcatataagtagagtaaataccagcgaacggctgataatgagagtcttccagcaaactggatgagcgtatggcaataggagacttcaccacatcgaaaaaggcgaaaaagtcttcaaccagccggtcgggcaacttggcacgcaggaaggcacgcaggattgtctcatcgtcggcatcgcttaacgcaacctgatacaactggttcatatccatgaactcatcgaagatatcggtacaaagtactaccgttttcggaataacaacggaggcattttcaaattcttcaaactcggcatgccgttttaccatgttgtcgataaacgccagtccacgtccttttcctcccagggagccgtcgccgatacgagcgaaattagaataccggtcgaaacggtcgcgttcaaacacagccaccactccctgattcttcattttacggtatttcacaatcgcttcgaaaataatctgacgatgtgcgtcgatgtcctgcaagtctttccatgaaatctgcttcaggaactcggctaccggaaagatagcacgtgaatacaaccagcgtgaaatatgatttcgggtaatatgataaaggagtgattctgccggaatagaaaagatgacattttgcaactccttcagattatgtacccggactacttcctccatggtattgggattgcggaaaataaaatcgccaaaaccgaaattttcggaaacggcctcccgcaagtcaatattcattttcttggaattcttatcgatgaactgtgccccacaactctctgcaaagttcttattggtaacctctgccgactgaaggatcaacgggataaaaggatcacggctacgtacttcggtcaggaaacggatgcctgccttcggatcaatctgaccttcacgtggaaaacgtgcatccgatataatacccagcatgttatgctgatacctattatataaattcatggcttcttcatacgaacgtgccagcacaatcttcggacgaccacgcatacgcaacgtacgctggtgctcattcaaagcttcggttgcaaactcctgactctgacgaaggacaaacttatacaaatcgggcagtacggacgaatagaaacggatggaatcttccaccaacagaatcatctgtacaccgacttcctttatatcgtgttccagattcatcttgtcctctatcagcttgatgatagataccagtaagtcggtgtttcccaaccagcagaatacatactcgaaaatgctcaaatcttcgtgctccatacgttctttgataccatgagagaacggagtcagtaccaccagcggaatgtgagggtacttctctttaatctgccgtgcaatatcgaacgtatcgctgttgtccgatcccggcatacaaataaccagatcgaacatggtatttcccaactgcttccaggcatcttcttcggtagaaacctgtgtgaaacgaggcggataacgaagactgagattcatgtattcgataaatatcttttcatcgatacgtccgtcgtcttccagcatgaaagcatcgtaaggattggcaacaagaagtacgttaaagattcgtttcgtcatcaggttgacaaactgtgtatccttaaaatagagctgatttaattttaacttactgagcatagcttcaaggtttacgctttatttatttaacaaataacgggatttctattgatttgtgcaacttaccggcagagaaaaattactttcggacaaaaaatgtattaccgcgctttaactttttatcactttttagaggcaaaaacaagccaaaatattttgccattctaggtaaaatcctatctttgcaataacaaataatttcattttgtcagaccttaaacaaaaagatcatggatattaatcaaattatgtcatctttggaagctaagcatccaggtgaatcagagtatttgcaagcagttaaagaagttctcttatccattgaagatatctacaaccaacatcctgaatttgaaaaagtttcgttaattgaacgcctggtagagcctgaccgtattattactttccgcgtaccctgggtagacgataaaggtaaagtacaagtaaacttaggttaccgtgttcaattcaacaatgccattggcccgtataaaggtggtatccgtttccacgcatcggtaaacctttctatcttgaaattcttaggattcgaacaaaccttcaagaatgcccttactactttgcctatgggtggtggtaaaggtggttccgacttctctccgcgcggaaagagcgatgcggaagtcatgcgtttctgccaagccttcatgctggaattgtggcgccatctgggtcctgatatggatgttccggccggtgatatcggtgtaggtggccgtgaagttggatacatgtttggcatgtacaaaaaactgactcatgaatttacaggtacatttaccggtaaaggtctggagttcggcggttcattaatccgtcctgaagctacaggattcggcggcttgtattttgtaaagcacatgctcgacaagaaaggtatcgacataaaaggaaagactgttgcgatttccggcttcggaaatgttgcatggggagcagctaccaaagctactcaactgggagctaaagtcgtaactatttccggtcctgacggatacatttacgatccagagggtatcagtggagaaaagatcgattacatgcttgaactacgtgcttcgggcaacgatatcgtagcaccttacgcagaaagattccctaattctacatttgtagaaggacgtcgtccgtgggaagtcaaagtagatatcgcactgccatgcgctacacagaacgaattgaacggagaagatgctcagcatctgattgacaaccatgtactctgtgtaggagaaatttcgaatatgggctgtacgcctgaagctattgatgccttcatcgaacataaactgatgtatgctccaggtaaggctgtcaatgccggtggtgtagcaacttctggattggaaatgagccagaacgcaatgcacttgagctggtctgctcaggaagtggatgaaaagctgcatcagattatgcataacattcacgaacaatgcgtgaaatacggtacagaacctgacggctacattaactacgtgaaaggcgcgaacatagccggatttatgaaagttgcacatgccatgatggcacaaggtattgtgtaatagactttatatttataaagaaaaataagaataggaattacatttttttgttcccaaatttttgtttgtgatttctatttcttaattttacaatatatctcgtttagttgtatttgtattttgtattgtagcttgcgctgcctgcctgagaaggttcggcagcgtattttttttcagatttcgggtatacaaatctcaaaattggcgttaatcttaataaaaagtaaattataaatataaaatcgaacgccatgaaatatttgtccatcgccattacccttttggccattttgaatagttgcactcaagaatatttgttttctcctacagatagtacagtttccatcgtaggaaatttatcagtcccgtttcaggacaatacagccagaggtatcaggtccaattacctaccagatggaagttgcatatcattctatagttcaggaggaatatctgccgacaatttattactaacctatgaaaaggaaagatggaatttccctactgaactacaatggaatccagaacgatctgaagctactatcaccgcctattacccatatatagaaaaagacttttgtccctatgaaaaagacggaagtctaaaagatatattgtatagtactggcattttcaaataccaaagtcctattactctgcaattcaatcatacaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgatcatatattctcacaacttatttttcaagttaacgctcgcctaaattctcatttagaacaaataagctttaccccttctatttcaataaataatattgattggcgacatgcacaactgacatatacatcagataagttgcatacacaaaaattcacgaaacaagaaaatggaatttataagctgatagtcccacccgcatcaaatatctcgataaatattaccttaaaaacttctgaaggtaattatacagcgcagctcacaccaacaactttccaacagggatatcaatataaatataatcttaagtccaataacgaatgtggcataagtacagcagaagattttattgcttttacccatttaatcaacggagaagtttactccaacagaacgttagatgaatttggaacttccaataatggtaactggacatattacttgctcaatgatatttacttcactcccgaacaatgtgaacgactacaacctatcggacgcattgagtcacaggaagccaattatatgggatttaaggactgcctggacggacagaatcattcactatacaatttatatctcaccccaaaagaagatatggattcatatgctctgttttcttgcatagatacaacaggcattgtcaaagacttgaacatagtaaatgcttcattcaccggaagtcatatttgcaaatacgaagctatacttgcaggaagaaataacggcactataatcggatgtcatatcaagggcaataatacttttgtagaaatgaatgacaacaagcctggaggaatgattggtatcaacaaaggatgcattataaacagttcatctgagaacattgattttcaacaccccaacgggaaagttggtggaatttcttatagtaattcaggtaaaatactgaattgctatacaagtgaatgcaattttcttcatactcaggctggagcaggcatctgctatacaatggaacctaggagtgaaatgaaaaattgctatgcttttaccactgccggatatccgtcaaagaaaaaatatgccgcacttgtctactccgcaaacaactgtataatagaatgcggattatcttgtgacgatgacataaaaacggtttacggtagctatcaaactactctcaaagagatatatacttatgatgcacagaccatgaaaactcaaaatggaatattagtcatggatatactcaataattggattgagaacaatgcttctctttaccctcaatatactttctatgactggattacaggagatacccctcctatcatcatacaacaaccatagattatgttttttttatactcaaggacaatacgtatgcataaaatgttgtatttttgccgcaaaatctgtttctcatggaaaaaaataaaaaattagtgattattatagcggccttaatcgttgtggttgccggagtttcatttttagcgttcaacgagtttcgcaaaaatagagaaatgaccgaggtattcgctgtcgaaaaggaagaaatggaaaacgaatacagtactttcgccactcaatatgatgagcttcaagtacaaataaataatgactccctgcgcgaaaaactggaaagtgaaaagttgaagacacagcgcttgctggaagaactgcgacaagtaaaaagcagcaatgcagcagaaatcatacgtcttaagaaagagctgaagacggtacgtgccgtattgagaagttatgtcatgcaaatagactcactcaatcgtctgaacgcagccttaatggtagaaaatcaggaagtgaaaagcaagtatacagccgcaactgcacaaatcaacacgctcgcggcagagaaaaagaatttgaacgaaagagtatcgctggctgcacagcttgatgcaacgaatatctctgcacttccgatgaacaagcgaggcaagaaagcacgtaaggtaaaagacgtgaaaaagattgctatatcatttaccatcgtcaaaaacattacggctaagactggtaacaagacgatttatgtgcgtatcgccaaaccgaacaatgaaattctatcaaaaagtaatacaacattccaatatgaagatcgccagattacttattcaataaagaaatatattgaatataccggtgaggaacaaagtgttactgtatactgggacgtagaagagttccttccttcgggaacatacaatgtttatatatttgccgacggcaatatgattggccagaattcatttgaaatggaataatacctttatgagaaaaaaaccgatctatttcatactaggtcttatgctctcgacagtattcatgttgtcgtgtggagaagatcgttccggagaatattatgccttgattggaagcaagacatggatttatgaaaccatgcaacagaactatttgttctacgaagaccttcctgctgaagacggtcttgattttttcgataagcctgccgactttctggagtcggttgtatccgatcaggataaaaaaaacggagtaaccttctcacacattgactccgtaaaaacgacacgcgtactaagcaataatcctacttatggaattgaaggtacattggttcgtggtaccgacggcgactattattataccattttatatgttcagcctgaatcaccggcaagcgaagcaggactgaagcgaggtgaccacatctgcatggctaacggaaccaagctcagcagcagtaattatgctggatatatccagacaccgacaacggcttatacatacaaggtagccagaaaaggtgaaagtactacacccgatacgctagagatacccatgcctcagccacgtataattgaagaacccagtgtctatctgacacggaattttacaacatcaaacgggaagaaggttttctatatcatgtataatagtttcgaaacttctgaagagtcagacctgaaaagcaaatttgcagaaggactggcctcttctcccaatgatattgtcctggatctaagatacaatccgggaggatatgtttctaccgctcaattgcttagcacaatacttgctccatccaatgcaatgggacaaaactgcttcaacctgatctttaacgacaagttgaataaagtggagaattatgcattcgatccggcattactgcaaggagtttccaatgcctcgtacgaacatctatatatcctgacgacaagcaataccgcttcggcctcggaactggttatcaattgcctgcgtccgtatctgggtgacaaactgcttcaagtaggagaaaataccttcggcaagaatgtagcccaaagcttgtttacgaatgcttcatactcaaaactggaattttggctgactactgcatatatcagcaattcagaaaactactacgattactacaccgatggattaaaatccgattataccgtcagtgaagacgtatcaggatacttgggagaattaggcactgaacaagatgcattaatggctgccgtattgcatcacatcgaaaatggcagttttccagccgtagaaactcctgaaacgcaatctgctgtcagtcgcaacttcggaatgaaccaaactccgcgggtcatattcaattccattgcacataaactcaagtactctaaaataaccaaatattaattaactcaggccaataagctaaaaaagcaaaaaagcattaatgcaataatccttttcaacctttttacttggtggattgtttatattgtgatacatttgcaatgttgcataagcaactaaaacctaaagtagaatcggtaatgaaaagagttttaagtttcattttattgttcgggctggctctgagcagttatgcccaacgaatcctaaacctggacagttgtcgtgcattggctctctcgaacaacaaagaactacgcatcgcacaagagaaagtaaatgccgcacattatcagcagaaagcagcatttaccaactttctgcccaagatagatgttacagggagttacatgcgtacccaaaaagaaatatcgctactaaacgatgaccagaaacaggttatcggtaacatgggtacaagcgtaggcaacggactgcaacaattgggacaggaattgcaacaggtagctatgcaacatcctgaactccttcctctccttacccctttgaataatgtgatgggtaaaataccaggagcactcaatcaagccggacaaagtattcttgacgcattccgcaccgatacaagaaatctgtatgtcggagcagctacactgacccagcccattttcatgggaggaaaaatcatcgcatacaacaagattaccaaatatgcagaacagcttgctcaatcgcaacatgctacaggaatgcaggatgtcatattgagtacagaccaggcttactggcaagtcatttccctcgtgaataaaaagaagctggccgaaagtttcttacaactagtacagaagctggactccgatgtaagtaagatggttgcagaaggtgtagcaaccactgccgacgaacttagtgttaaagtaaaagtaaatgaagccgaaatgaccctgacacaagtagaagatggactcagtctatcgaaaatggtactatgtcaactctgtggcatccccttaaacacagatatccgactggcagacgagaatatggaaaatcttaccttacctgatatgtatacagaaagtaatgtaagtacagccttcgccaaccgcgaggaattgaaatcactggagcttgcagaaaagatttaccgtcagaaagtcaatgttacgcgcgcagaatttcttccttctgtcggactgacagccaactacttgttttccaacccgtcactagtcaacggatttgaaaataaattcagaggaatgtggggaatcggagtcattgtaaaaatacctgtattccactggggagaaggtatttataaagtaaaggcagccaaagcagaagccaatatagcccgctaccagctggaagatgtaaaggagaaagtggaactacaagttacccaaagctcatataaagtaaacgaagccgtcaaaaagctgaacatggcagaaaagaatatggaaaaagctgaagaaaatctccgatatgctaacctgggctttaaggaaggagtcattccaaccagtaacgtactcgaagcacagacagcctggctctcagcacaatctggaaaaatcgatgctcaaatcgatttgaaaatgagtgaaatatatttaaacaaatcaatgggaacattaaaataacaaaccaatatgaccgaaaaatctcaacgcagcaatatcatgctggcattctttacacttgcagctgtaattgttattgtaagcattatcgggttctttaccctcggaaaaggtcctgaaatcattcaaggacaagcagaagcgaccgaatatcgtgtatcaagcaaagtaccgggacgtattcttaaattcctggtagacgaaggtgacaaggttaaggcaggcgatacacttgccatactcgaggcccccgatgttcaggccaaattgtcgcaagcacaagctgcagaagaagcggcacaagccctaaatgaaaaagcaatacgaggcactcgttccgaacaactccaggctgccttcgaaatgtggcaaaaagcaaaagccggactggaaatagccgagaaatcatacaaccgtatcaacagactgtatgaagaaggagtcatgtcggcccagaaacgtgacgaagcaaaagcccaatatgatgcgatggctgctaccgaacgagctgcaaatgcacaatataccatggccaagaatggtgctcaacgtgaagataaggctatggccgcagctcaggtagaacgtgccaaaggtgccgtagccgaagttacatcttacatcaatgaaacttatctgatcgcttctgccgacggagaagtgacagaaattttcccaaaggtaggcgaactggtcggtacgggtgctcccatcatgaatgtagcccaaatgaatgacatgtgggtaactttcaacgtacgggaagattacctgaaagacttcaccgtaggaggtgaaatcagcgcctatgtaccggctttggaaaagaacgttacattcaaggtcacttatatgaaagacctaggtacttatgctgcctggaaagcaacaaaaacaaccggacagtttgacctgaaaacattcgaagtaaaagctaaaccagtacagcctgtagaaaacttacgcccgggaatgtcggctatcattgaaaaataaaaaacagtcatgtcaataaccatccataaacgcctgttacagattgcaaagcgagaagtaatgcgcattgcaaccaaaccaatgtatctgttctgcatggtaatagcccctgtcttcagttatatattcttcacaacactgatgagcagcggactacctaccaatatgccggcaggtgtagtggatttagataacacctcaacgactcgtacaatcatacgtaacctggacgcttttcagcagacaaaaattgtagctcattacaatagctttaacgaagccagagaagctgtacagcgcggagaaatttactcattctattacataccacaagggacgacagaaaaagcaatcgcaggcagacagcctaaagtttctttttacacaaacttttcgtacctgatagccggctcactgctttaccgagaccaacgtaccatgagcgaactggcttcggcggccatcggacaaagtaccttactggctaagggcgctacagaagaccaggctatggcctttctgcaacccattgtgatagatacacatgccctgaacaatccgtggctgaactattccgtatatttgtgcaatacacttttcccaggaatattgatgctgctcatctttctggttacagcctacaccataggcgtagaagtgaaagaaaatacagcaaaggaactgatgcacatggcagataattccatcgtcacagcactggtagggaaactattgccacagaccatcattttcttcatcatcgctgtattctataatgtatatctttatggattcctgcattatccgtgtaacagcggcatattccccatgcttttggcgggactgttacttgttcttgcttcgcaggcagtaggcatattctttttcggattattcggaacactccgtctggcactcagcgccgcctcattgtggggagttctgtcgttctccatttcaggattcacctatccagtaatggcgatgcacccgacgcttcaggcactgtgcatgttgtttcctttacggcattattttctgctatatgccaatcttgctctaaacggttatccgctcatttatgcatggcattctgtggtagcactactgatatttatgctgcttccattcttcgtactgaaaagattacgtacgattatgttacactatatctatattccttaaaagcttgattcatggaaaaatattcactccgacatacaatacagcaagggttcaacggattattctatattttcagaaaagagcttaaagctaccatcaaagatcagggagtactgattttcttcctgctggtaccattggcttatccgctgatatatgcttttatctacaccaatgaagtggttcgcgaagtccccactgctgtaatagatgcaagcaacactgccctcagccgaaaatacatccgcatggtagacggaacaccggatgtacacatacaatcttattgtgctgacatggaagaagccaaacaactgctgaaagagcagaaaatatatggcattatttatatacccgaaagcttcagccgcgatatagccgaaggaaagcagacacatgtaagcatctattgcgacatgagtggcatgctgtactataaagctattctgctggcaaatacagaaacctctctgaaaataaacaaagacattcagataaaacgcttagggaatacgactgagcggcaagatgaaatcagtacaactcctatagaatatgaatcggtttcgctattcaatccacaagacggatttgccagctttctgattccggctgtactgatactgatcatacaacaaacactactgttgggagtaggtctgtcagcaggtacggcacgtgaaacgaaccgtttccgcgatctcgttcctatcagccgacaatatcagggaaccttacgcatcgtcatgggcaagtctttggcctacctgatgatttacgctgtcatggcggcatatattctgtgcgtcgttcccaaactgttcagtctggtacagcttgcacaacctgcaacgctgttctggtttacactgccttacttgctggcatgtattttctttgccatgacttgctcgattttcatccaccacagagaatcgtgcatgctgattttcgtattcacctccgtacctctgttgttcatatcaggtatatcgtggccaggagcggccgtacccaagttttgggaaatcttctcctggatattcccatccacttttggtataaacggttacgttcatatcaataccatgggagcgacattacacgataccttaccgcaaatcagagcattatggatacagaccgtcgtttactttttcacaacctgctttgtataccggcgccagattatgctgagccgtaagcatgctatggaccgtctgaaagcatacaggaagaagaaacgacttctagttaactaaaatcaaactctttcatacagcaaaaggctcttctttcgcttccaattattaaacggaagtagaaagaagagccttttttatacgataagacacttacctgtatcaatacgattcatgcaggctctcgatatatccatacaactttttgtagaaagcatgtctggtcagtgtagaagcatctcccaatataatcagcttcatacgggcacgagtaatagctacattcatacgacgcaaatcattcaaaaaaccaatctgcccttcttcattggcacgcaccagactgatgagaataacatcacgctcctgcccctgaaagccatcgacagtattgatggttatcgcctgccggtaaggcttgaaaaaggcatcattccgaaccagccgacgcaaatactgcacctgtgccttgtaaggcgaaatcaaacctacatcaattcgttcactcagaaacctctcccgaccaattttggtaatatactcctttaactgggcaatagacaactctgcctcgggtttattgatacgtccataattctcaccgacaaactcctcattgcagtccattccctccgtatttatccattcgatgggagtatcgaaatcgagtatactccgatattttacttcgggagccgattgtaacatgcctccataaaaccattcagacgaaaagcgcatgatttcatcattcatccgatactgaagtttcaacagagaaaccgtttcaggcttgtttttcacgatggtctgcatcaacgtatgccccaaccctgcccgaagcgcttccggagcttttaccgtaggaggaagctgacaatgatcgccggccagaatcacacggtctgcctttcggatggcaatccagcatgccggttccaacgcctgtgcagcctcatcaataaacaacgtgccgaatttctgtcccatcagcagacggttggcactgcctaccaatgtacacgcaatgactcgagcctctgcaaacagcgactcattgacacgtatttccagttccgtggcacgatctttcagagaatttatcttttgccgaatggcttcacggtccgttcccttccgcattcgggcatacagttcgcgaatagccttacgcatactccacagttgcggataatcgggatgcgactcgaaacgccgctcgtaagtaaacgaaagcatcttgtcgtttacccgactgggatttccgatacgcagcacactcactccacggtcgaccagcttctcgctgatccagtcaactgccatgttactctgtgcacacaccagtacctgattttcacgatgtagcgtttcgtagacagcttctaccagcgtggtggttttacccgttccgggaggtccgtgtacgattgccacatccttggcatgaagtaccttgtttactgcctcctcctgcgtacggttcaaccacgggaaacgtaccggctggaatgaaaaagtggaaacgggctgagttccatgaaaaatatcacgcaattctgccagacggttgttcttggcacttattacttgcttcaaggcttcaaacatcagccggtaactggtttcatcgaaatacaactgcacccccagtacctccttactctgcaaggcaagcaaagcgtctacagaaggaagaatcaccaccatacggtcttcatccacataattcaccgtcgctacgaaattcaggtaattcagcttacccgatatatcctgtgtgaagaaacagaccggacgaccatactcaaactgatgctcaatttccttatcctcccgccgttcaacctctacgaccaactgattaagggcattgtaataattccgccccaaattcaacggataccagcacattccacgtttgattttccgtcctattcccatcagctctgtctgttgcttgaactgttccttttcatattcgtactccatctgcaacaattcatactgatgctgcaaataaagtatcggagattttatagtcgtattttctttcatacaccaatcatcttacacatccgtcacataaggttatagccatacgtgacgtcaatcttgattttttccttttgcaaaggtaagagttcttcgaaaaaagagcggcggaaacattgatttattcccggattatgcgtacttttgtttagaggctataaaaataatgtaaccatgaggaaacaagctgactatattaaacgtattgagattaaaggcctgtggggaagaaagaatatttcgtggaacttgcgtgcggatgtcaatattctgagtggtataaacggaatcggcaaaagtacgattctgaataattctgtacgttacctcaacgaactggaaggacatgcgctcaccaacggagttcaaccgggtgtttcgtttatcttttctcccgaggatgccaacttcatccgcttcgatgtgattcgcagtttcgaccgtccgcttattaattccgacttactggaaaaaattggaaatgcaaatgtcaagacagaattagactggcaactgtatcagttacagcgccggtatctcgactatcaggtaaatatcggaaaccggattattgagctgctcaccagtggagtagcagaaagccaggcacgcgcagcagatgtttcacgtcctaagaccaaattccaggatctgatagacgatttgttcagcgaaacaggcaagaagataaaccgcaaaagcaacgaaatattattcgaacaagacggtgatacactgactccgtaccaactttcatccggagagaaacaaatgcttgtcattctgttgactgtactggtgcaagacaaccagccctttgccttattcatggatgagccagaaatctcacttcatgtagaatggcagcaacggcttatcgcacttatccggagcttgaacccgaatgtacaaattatactcaccactcactccccggctctcatcatgaacggatggctggatgcagtaaccgaagtaagtgatataacaactcgttaaaacaattacggctatgggaaaaagactcacagacaatcttacttcactctatattggagccgccaatagtctgaagcccaaacaggcacgaaggaaaatcgttgcctatgtagaaagttacgacgatgtttctttctggcgttcccttttggccgaatatgaaaacgacaaacgttattttgaggttatgttgccctcacgcagctctctagccaaagggaaaaagaccgttctgatgaacgaactgggtagtcacctcggagaaaacatgatagcctgtgtagacagtgattatgactacctgcttcagggaaggacacaaacatcacgttacattatcaacagtccttacgtactgcaaacctatgcatacgccatcgaaaattaccattgctatgccgaaggattacacgaagtatgtgtcacagctaccctgaacgaccataaactgattgactttccggctttcatgaagctgtattcggaaatagcctatcctctttttgtctggtcggtatggttctatcgtcagcacaacctgtcggaattttcactgctcgatttctgttccttcgtaaaactggatcaggtcagtacacgtcatccggagaaaagcctcgaaatcatgtcgaagaaagtcaaccgtaaacttcatgaactggaaaagcgtcatgcggctgccctcgatgaaatagaagatatgaaaaaagaattccgtacgctgggagtctatccggacaatacctacatgttcatccaaggacatcacatcatggacaatgtagtcctgcgtctgctggttccggtatgtacggtattgcgtcgtgaacgagagcagcaaatacacgacctggcgctgcacgatgtacaactccacaacgaactcacggcatatcagcgtagccagatcgacgtggaagtagtaatccgaaaaaatcctcattaccagtcatcgcctctatacaaaaaaatccagcaggatatagagaatttttttaaaatagccaagtaaacggctttacggctttcgtatctcgtaccctaatctgagtaatccgatacagccatgtacccgactgttttttatcacatgaaaagccggctgtatatacatgttatgcaaacaagcaatccggcaggtcagttcaccactccattcgtttccttcagcaaaacctgcataaccggcaaacaccccactttccagtttgccacaatgcaataccagagcaccaccagcatagctccggcaaccttttaagactgtaggattaaccgagtattgaatcaatgcatgccaatgagctgacaaattctgctctgcatatccccatactaacgcattccattcttttttttctttcgactcttcagttcccttctcataacaagcagacatcccgttacgtaaagcaaaacccatataataactgctgccattgttctgataattaattgttgatatccccagtatgccatcactttcaggacagaaacgaaagacattctcacgtccggtcagtcttttataccccactccattgtaagcagaagcctcaaaactctatctgtttcctttatacttatagtctattcctatcgaagccagaggataattggcaatgggataatttacagataatgtagggaaaatgccacacgaactattggtaaacaaggaagtataaggagatgtaaaatagtcttcattcaaattacgaactcctacaaacagaaacgacttttttaactgccaccttatacccaatacagccaacgccaatggagtattttcttcctcaatattagaaaatccctgccagtcgtctatcaaaggcctctcatgtgtttcggcaatactgattgaagccatctccatgccgaaattttttcctataggaaactcaaactctgcccggagcagattcacccactttgttcctttcctgaaatcggtctggaattcggatgtataggctatacccgtttcctgtgctgcaagacaatgactatagaaagtaatcattgacattgcagcataaaaaacattagtacgaattttttttgctataaccattttacaaatcgcctgatataccagttcttcacgagctgtgtcagtatgcaataagaaagtaaaataccgaacaaccatgggaaatagcttaacggcaatgctcccagcccgatagaacttccaaaaggagtaaacggaatgataatgccgatagccataatcaggaaggtcagaccggtaacctgccaggatgcacaactctgtatgaacggaattttccgcgtacgaatcatgtgcacaatcaatgtctgcgaaagcagtccttcgatgaaccatcccgactgaaaaagagtctgatgcgccagcgagttacagtcgaacacataccacatcaccaaatacgtcacaatatcgaaaaccgaactgatcggaccgataaagatcatgaaccggctcaaatcggatgcatcccacttacgaggcttgcgcagatactcggcatccatacggtcgaacggaatggtagtctgcgaaatatcgtacaacagattctgtataagcaagtgaataggcaacatgggcaggaaaggcaagaaagcactggcagccatgacgctgaacatatttccaaaattggaacttgccgtcatcttgatatacttcgtgatatttccaaacgtcttgcggccttccagtacaccatcttccagcaccatcaaatccttttccagcagaataatgtccgcactctcctttgcaatatccacagccgaatcgacagagataccaatatccgactgacgcaacgccgatgcatcattaatgccgtcgcctaaaaagccaaccgtattctgctggtcctgcaagatagaaataatctgcgttttctgaataggagtcagcttagagaaaaccgtcgtttcacggacagccttatgctgctcttcgctactcattgcagccagttccggtccggtaagcgcatttcccgtttcaatgcctacctgacgggcaatagtacgtaccacggcatcgttatctcccgacaagatttttacttcaatgccatgctcgtgcaactgccggatggcacttgccgccgactgcttaggaggatcgagaaacgccagatacccgataagcaccatttcgttctcatccttcacacagaaattacattccttgtccagataactcttctgtgccacggcaatgacccgcattccctgcttgttcatctgctcactgatttcttttgccttctgtttcagttcgggcataaagggctgcaccttcccttcaaattcggcatacgaacaaatttcgagcatttcttctaccgctcccttggtgataatctgccgttttccctgtttatcttccaccacaaccgacatacgccggcgagtaaaatcgaacgggatttcgtcaactttcttgtaattatccttcaagtgttccagatcaagatccttcacatgcgaaaggatggccttatccatcagattcttcaaaccagtctgaaagaaactgttaaagaacgcgtggcgcaaaatacgcttatcgttgtcgcttgagccatcggcgttgatgtatttttccaaaacaatctgatcgcatgtcagcgtacccgtcttgtcggtacacaaaatattcatagcgccgaaattctgaattgcattcaaatccttcactatcgtttttttcttcgacatggctaccgcccctttcgacagattggctgtcacaatcatcggaagcatctccggagtcaatccgacagccaccgataccgcaaagataaaagcctccagccagtcaccttttgtcagtccgttcaccaaaaagacaaagggaatcatgaccagcatgaaacggatcagcagaaaactcaccttactgatgcctttgtcgaaagccgttgccgcccgatgtccgataatccctttggcaatcgttcccagatacgtattgtttcccgtagcaaaaacaattcccgtagccgaaccgctcaccacattcgaacccataaagcaaatgttgtccagctctaccacgctacccttgctgtacttctctcctttcggtaccggacacttttcaatcggatccgactctccggtaagcgaagactggctgacaaacaaatcctttgcctcaacgatacggatatccgccggaatcatgtcaccggcagctatcatcacaatatctccgggtaccagttcggcaatgctgatttcttcgtcgtgacttccagcacgtttcacataacacgtgttggtcaccatcttcagcaacgcttcactcgacatgtttgccttccactcctgacgaaaacggagaatggcgctgcacactaccatcacggaaatgatgataatagccgtccagtcctgttctcccggatcggcaagcagcacatccagcacgaacgaaatgataaccaaaatcgtcagaacaccgataaacggattaataaacgtcttgatgaaggtagaaaccggatttttcttcttttcatgttccacttcattcttgccataaagcgactgtctttcctctacttcttccacactgattcccgccggagtagtctgaaaataactgaatacagcgtccaatggctgagctgccgccaaaaataccttctcggcattaaaagcgaactgtgtcttacgcttcttgtccttccacattgtcatacttcgtttacaagttactaccatgtatctttttcacgctgcaaaagtagaacggacactgcaaaaagacagttagaaaacaattagagtggtattagaaaactattagaaaaatacacaaacagatacttagctattagaaaacagccagttatgcaacttaaatgggcgtgtttattttctttttcacgcctcattgttaaaatataaatcctatatatgcggaagttcaatgacgaaagtcgttcccttgccctgctccgaatgtacactgatatttccctgatgcagatgaataatcttctgcgacagcgtcatgccgataccatgtccttccgccatcttctcctgttcccctctatagaacaaggtaaacagatgctgcttgtcggcttccgacattccgatgcccgcatccgacaaacgtacgatggtccacttatcccagtaagatatctggataaacgaagacttgtcggcagaatacttacagttattttcaatcagattcgagaaagcaatgttcagcagatacagattccctttcaccgtaatcagacggtcatcctctgcctcctcctgttcgaacaacaaatcgatgtgataatctggatgagcacgcaaaataaattcccgagcgtccagcaacaattcgtccagccggatttcctgcatcttgatatgctccttctgatagtcggccttcgccagattcaacaagccgtctatcagcttcgtcattctgcgagcatcgagcaacacgttctgcattgcctgcctgtactgctccccgcttcgttccttctgcaacgacaaatccagctctgctatcagggctgccagcggcgtacgcagttcgtgcgacacattgctgacaaacattttctgcgagttgaacgatacctccaagcgctccagcaaagcattgaaagccgtactcagttctcccagttcatctttttcgtttttcacaggaagccgccggttaatatgcaatgccgtaatggtttctgcttctttcacaatatcccgaatcggtttcagcgacgcacgggcaagaaaataccctgctgcaaacagcaacgacaatccgacaacaaacaagacgaccaacgttttctgcaactccagcaaattatcgtagccatatccgtcgtaagcaacggccgttacaatgtagtctttccctccgaacgaatagcgtattcccacagcctgatacttgccaatatagaactccatctccttttctttcagaatacggtctatcatggcacggtcttccttgataatatcgttctgtaccgcatcgtgataaagcatctggaagtcggcagaatagacagccacttccacttcgttgataaacttcttgttgttcagataaatagactgcatggtctgtgcatctacctgattctgaagaaacaaatgcgcctttgtcactgcctcacttttcaggtcgtggaaaaacgtcttgctgcgcgtatgttcgcttaccagataaatcaacaccatgcacagcagaaaaacggccgccgtaacacacgtattctgtaaagtcagtttcgtttttattttcataacttatccgttaaaatgaaaccgataccgggtttcgtatgaatgagcttgacatcaaactccttgtcgattttctttcgcaggtaattgatatacacatcgatgaaattcgttccggtatcgaaatgcgtattccatactttttcggcaatctctacgcgactgatgactttctctgcgttttcaaccatatacagcaacaggttgtattctttcggcgacagctttatcgctttcccctgccgtttcacctccctgaggctccgattgattgttaagtcggcatactcaatctgctcaggcgtatcggctaccacttctttattccgtttcagcaatacctttacacgcgccgtcagttcccggaaatcgaacggtttcgtcatatagtcgtctgctcccgcatcgaaaccatccagtttgtcatcggtagaacccaaagcggtcagcatcagtataggtaccttttcattcaggcggcgaatctccttgcaaagctcgaatccgtccatcttcggcaagataatgtctgatataaccagctggaaagaataagcctgaaaaagacgtagccccatagctccgtcgtatgccaccattgtctgataaccgttctcttccagtccggctttcagcaggtcggccactcgcttttcatcttctacaatcagtattgtctgcatactctctgaatttacctaatgatattatttgcctgcaagtacagattacaacgcatatccccgcccaatagttgacaggtttacaaatatagtgaatttattttagccacaaagtgtacgtatctttatgccaccggaagtttctttgccccaaacaggcaacgtctctataaaacatgaaggcaaatacagaaaaacgtcccgacattttctgaaaatttgtacaaatcattagattttttgtacaaaaaataaagtagttctgtaaagcttgttgagaaagcacctcaatagttatcagaaattctacagctattcaagccatcacatggcatagaaataaaatccgacagattgactttcctgaataaataaaagccgaagagagagaggagaacgttaaaaaacattataagcaatatattttttattcagcttctattcatttaaaataataatatatatcttagtagaaagataacaaaataaaaatatacgaaaaaaacacatctgtagctacacacagcaaaatacaaagactatacgagatcatccgcttgctacaaatacaaagactatacgaggtacatactttaaataaatcataaccttaaatcaagaataaagtattaaccttaattgtttaactatgcaaaagcgatcatttctagtagtcacaatgttcctgataggaatgttcttgacggggatttatgctcagactattaccgtaactggtaatgttaccagcaaagagatgggcgatcctctcattggagtaaatgtattagtaaaagggaccactaatggtacagtaaccgatttaaacggtaattattcaattactgtaggacccaatgacgtgctggtcttttcatatatcagcatgaaaaccgttgaggagaagataaatggaagaaagacaatcaatgtatcaatggtttcggatacggaaactttaggtgaagtcgttgtaacggcaatgggtatccagcgccaatcggaaacgctaacttattctgcacagacagtgggcggcagtgacgtaaacgacatcaagagtgtgaacatgatcaactctctgcaaggcaagagtgccggtttgatgattactccgaactctactggtgccggcggttcttctaaaatcttgttccgtggtaacaagtctatcagcggtagtaaccagccgttgatcgtagtagacggtgtaccggtaatgaacagtgtttccggtgcacaggtaagcagcaactatggtggtgaacgagacggtggtgacgtgatgtcgaccatcaatccggatgatattgcctccatcaccttactgaaaggtgcttctgctgccgctctgtatggtgccgtagctgccaatggtgcaattatgattaccacgaaatcagctcagtcgggcaaggtttcaatcaatgtatccagcaatactacgatggaaacaccaatggtgttaccggaattccagaacatctatggaatgagtgacaacggtacatacagctggggagacaagctctcgactgaagcaccgaactatgcaaaagaattttatcgtacgggatttacaacgaacaactctgtttcgctggctggcggtaatgataatattcaggcgtatttttcttacggtaatgtgtactcagaaggtatgacaccaagcaatacgtatcgtagccataacctgaactcgaaggtagggttcaatgtactgaagagcgtacacattgatttcagcgcgaaatatactaatcagtatgtaaagaatcaggcggctgcgggattcttgttcaacccgctgacaggtgtgtatttgttcccaagaggtgaagactggaattattataagaataattacgaggtgtacgatatatcaagaggtatcaatatccaaaactggacgaataccgggctgcaacagtatagtaacccatattggacactgaacagacaaacgccgattacggaccgcaaccgttatgaattcggcggaagcatcaagtgggatatcaacaaggactggaacatccagggacgtatgcgttacgaaagaggtgaagaacgctggcagcataacctgtatgcgtctagtatcgccaacttgtatccgatgggacgtatgaaggataaccgttatttcagcgaccagctgtacggtgatatattgctgagctatagccatacattcaatgatttcctggtttcggctacggcaggttccagcttcaccaagagtaagacatcgcatgtggacttatgggcggaaggtacgcagtttacttcaccgggcaacggtaacgtgtattatccgaatatcttcacaccgaacaactattacggcaacatgtctaccattggcaagaatgataactggaataccgaaaaacgcctgaatgccgtattcgctacagctcagttcggctataaggatggcttgttcgtcgatgtatctgtacgtaacgactggtcttcagcgctggctttcacagaaagctgttcgttcttctatccgtctatcggcggtagcttcctgctcgaccgatttgtcgacttgggcaagaacgtgaacctgctcaaggttcgtgccagctactctatcgtgggtaacgacgtaccggtattcatgagtaacctgctctactccttgcagtcgcagggttctattactcctccggaaaatgctccattccgtacattaaaaccggaaaagacgcactctatagaagttggcttcgacggtacattcttccagaaccgactgacattaggactgacttactataagacgaatacaaaaaatcagttcttctcggtggctgctccgtatgaatcgggcttgcgcaaccggtatgtcaatgcgggtaacgtgcagaaccagggattcgaatttacggcaggatggtatcagcagttcaatgaaaacttcagctggagtaccgacctgaacttctcgtacaacgagaacaagattgtggaactggtggatgacctgccaaacggactgacactgacagacttcggcggtgccaagattatcctgaagaaggatggctcgtacggtgacttgtatgtccgccacatcatgcgtgacgaaaacggcaaaccgatgaaggatgctgcgaccggcaacccgattgtaagcggtgatacaactactgatatgatttatgcaggcaacatgaatgcgaaattcaatgccggatggtcgaataccttccattacaaagatttcactctgtcgttcctgatcgacggcaagttcggaggcaaggtattgtctatgacggaagctacgctggacggctggggcgtttctaaacgaagtggtgaagcccgtaatgcaggcaaggtggtagtagatggcgtagaattcgaaccgaaagcatggtataccacaacaggtgccagcaacttcaacagtccgtatgccaacgaattttatgtatacgacgcaacaaacgtacgtctgcgtgaattgagcttaggatatacattccgtaatttattcggtgcaggaaagaacctgacagcagccatcatcggacgtaacttgttcttcttctacaaagatgcacctatggacccagatgtatcagcaggtaccggtaacggtgtacaaggtgtggacatgtttgcgttgccaacctctcgcagctttggtctgaatttgaaacttaacttctaaaatgcctgattatgaaacgaaataaaatttatcaatatgccattttgttggctcttccttggttaggaggtaacttgatgacttcatgtacagatagttttgaagatctgaacacaaacagtgtacaagtcgacccaaatgatctgcctttctctgcacaatgtgccgaaccgatgcagtactgctatccgccgcagcagaatatgttccagttctggactaacctgaccatcgacttgtacagcgggtatttcatgacaccaaacggtaactttaccaacggggatatgggagaaaaccgtggacatagtggaggtatgtacgaaaattattacttgcacatcttcaataatacacgccgtatcattgccgactgtgaccagaaaggaacgttaggattgtctggtgtaatgcgtatcgtacaagcgtatggtacactgatgacgactgatgcttatggccctctggcttacagctcaatcctgtcgggtgaatatgaatcgtattatcctttcgacagccagcaacaattattcgtttccatgttgcaagacctgaacaaagcgattacagacattaagggcatgagcgaaagtgaaaagctgacactagctactttcgatatctggtgtagtgcagatacggacttgtggataaagattgccaatacattgagactgcgtatggcactccgcctgtcgaaacgtgaagcagaaatgaaggaagccggtattgacttgaagcaggtggcaacagaagctgctgccaacacgctggcaacggtgaacaaggacatcgtcatcgacaagagtctggaaaacgaaatgtggctgatgttcaactggggtgactgcggtttcaacgcgaacctggttacgttgatgtcgggcatgaaggatccgcgccagccgctgtacatgaccaagaacactgccgatgtaatcgatctgaatggtaaagtagccgtaccggctaatacacaatacttaggtatccgctttgcaagtggtctgccgggcaagccgaacaactgggcgaatttctctcagtggatcgacccgcagaacagcatcggtgtctattccatgccgctgcctatcttcaaggctgccgagtcttacttcctgctggctgaagcaaaattgcgctgggacatcggttcagcaagtgtacagagcctgtacgaggatggtatccgtgtttccatggcaaacgaactgagctaccgtggcaagtatgcgggtgtaagtgcctacgaagaaggtgcagtggatgcttacatcaacggtacgactactcaaattgatttcgtcgatccagtagatccgaaactgaatactccggctgtaaacaaactgtgcgtaaaatgggatgaaagtgccgacaaggaagctaaactagaacgtatcatcacacagaaatactttgcattgttcccgttgtcaatcgaggcatgggctgaacagcgccgtaccggctatccgcatctgttcccggcttatgtagatgaaagtaacggaggcgtaaacaaggaagaaggtctgcgtcgtgtcatctacagcagcaatgcttatgatacaaatgctcaaggtatcaccatgggtctggaactgctgaacaaggaaaataccagcaagaacggtatctcgggcgataagggtggtacacatctttggtgggataatgccaataaaggaaacttctgatacataactgtctttttaaagcgggtgagcctgaaaagctcacccgcttttttttgcaggactccgtccggcgggaaacgtgactgcctccaccgcgaggcctacggaaacggtatttgcgaaaatatttacagaaagatgcacaaatttcgtttgactggtctgatattttatattagctttgtaaacaaagagaaatttcatgatgaaagactatactatcgccgtagcgggaacgggttatgtaggcctgtccatcgctactttgctgtcgcaacatcaccgggtggtggctgtcgacgtgattcctgaaaaggtggagaagataaacaaacgtatcagcccgatacaggatgagtatatcgagaagtatctggcggagaaggaactcaacctgacggctacgctcgacggggctttggcttaccgggaagcggactttgtggtgattgcggctcctacgaactacgatccggtgaagaattatttcgatacgtcgcacgtggaggaggtcatcgacctggtgctggaggtgaatccggatgcggtgatggtcatcaagagtaccattcccgtggggtactgccgcagcctgtacgtgaagtatgcggaaaagttccgtacctctcctgccctggcgggaaagaagttcaacctactgttctcgccggagttcctgcgtgagagcaaggcgctgtacgacaacctctaccccagccgcatcatcgtgggatgcccgaagctgatagagggacgcgacgaggagaacagggcgattcaggccatcgcaggcgagcatctggaagagaaggcgcacgagtttgcggcgttgcttcaggaaggggctatcaaggaaaacatcgatacgctattcatgggactgaaggaggcagaggcagtgaagctgttcgccaacacgtatctggcgctgcgtgtcagctatttcaacgagctggatacgtatgcggaggtgaagggactggatacgcaggccatcattcagggtatctgtttggacccgcgcatcggatcgcattacaacaacccgtcgttcggctacgggggctactgtctgccgaaggatacaaagcagctcctggccaactatcaggatgtgccggagaatctgattcaggcgattgtggagagcaaccgtacacgcaaggatttcattgccgatcaggttctgaagaaagcggggtattacgattattataatcacggggactataatccgcaggaggaaaaggaatgtgtcatcggggtgtatcgcctgacgatgaagtcgaacagcgataatttccgccagagttccattcagggggtgatgaagcggatcaaggcgaaaggggcgaccatcatcatctacgaaccgacgctggaggacggaacgacgttcttcggctcgaaggttgtaaacaacctggaggagttcaagaagagatcgcaggctatcatcgccaaccgctacgatgcgtgtctggacgacgtgaaggagaaggtgtatacacgggatattttccgcagggactagcaccgacgaggatgctttgttccgacgaacaacaagactgaagactaaataaaagacaaacagaacgaaacaaacataactaaagaccgaatttatgaaaagatattgtcagacactcgacctctacgacgacaaggagctgatagaggcctacgtggcagaacatgcgcacgtgtgggaggaagtgaaggcgggcatccgcgaagtgggtatcgtagatatgcagatttacatctacggcaaccgcttgttcatgatcatggatacgacggacgagtttgatatggagcgtgactatgcgcgactggctacgctgcctcgtcaggcggaatgggaagagcacatgtccaagtaccagaaggtgcttccgggacagacttcgcaggaaaaatggaaactgatggagcgtatcttcaagctttaatgcggagaaaaatctttttttcacgggtgtgagaaaaaaattttttcagaagcgtttttttacgaagggggatatagaccatccaaaagcacactgttttacagatagttacagaagcctattcttgaaaagggatcggcttctttcgtgtctgggaaagggaaatatcgtttttttcgaaaaaaatttcattcaggcataggggtttttccggggggctgcgttatctagtcaaaatcacctagctaagtgacttgaaaaaacaaagtgatttgaaaagaaacagtatcaaccaattaaaaaactagacattatgaaaattaaacttattacattatctttgtgtttattcgctggtgttaatttggcaaaggctcaggaaacaagtaagaactttactccttcggaaaacaagcatgagttccgcctttcggttagtgacggactgactcagagcacagtcgacgtactgggtatcggactaggtgacgcgattaccggaagcaagcgcagcgaccagaagtcgaccatggtatacggactgggttaccgctatgcactgaaccgcttcaaggtaggtgccgacctgggattctcgcagactagcagcaagctgatgctggcaggagaaacggctccgtctatcaaggaaaaggaactgaacttcctggtattgcccacagcggaatttacatacttcaagcgtagactggtggaactatacggtagtgcttcggcaggtgtgagcctgaaacgtcactcggaaacaggactgacagatgcaggcaagaaggcggcacaaaaaacagacttaaatgcagcatttgcttatcaggtaaaccctatcggtttaagagtaggtaacgaccgtatcggtggtttcgtagaagccggaatgggtcacaagggattcctgacagcaggtgtaagcgtgaaattttaattaacccttaaactagaacgcagacgcgataaaatgaaagcctatagaaaggaaatattcaaatccagatttcaggagcattatccgaggctgtgctgtatagcctgcggatatgtttcggacaaggaggatgcggaagatatcgtgcaggagctgtttatcagcgtgtggaacaaggggctggacagcttgtccgaccaggagttcgccgcctacatgacgactgccgtaaggaacagctgtatctcgtttctgagaaaacgccgggacgacgtggtgtcgatagaggattatcatcagccggcaagctgcatggcggatgacgacgacgaacaggatgaaaagtcgccggaagaggtgctggaatcggcactggccacactgccgccccgatgcaaggatattttcctaatggctaaacttcagggaatgaagtatcgcgaaatagccgaaaacctgaacctatcggaaaaaaccatcgagaaccagatgacaaaggccatcaagatgctgcgggcgtacgtggccaaacatggactggcactggctacggttgtggtcatcattttatcaatcatcgtaaattgtgagtaggatatgaattgcaaagaggatataaatgaattgcttgccaggtattttgccaaggaggagctgaccggaactcagcagaaggttctggatgaatggatttcggccaatgcagaggagtttgaacgcatgcggaagttgatggaagcaccggtaaaggtgcccgacaagacggatttcgacgcggaacaggcgtggaggaaggtggaagccaagctggaaaacaagtcgttctggctgggagtaaggcctcatatcgttacggtgatctcggtggctgcctgcgtgctatttgccgtggccatgacaacgacgtatttcctgcacaagcaggaggagaaggacttcatcaagtatgccaacgtgggactgcggctgaagcagttcatgctgcccgacagctcggaggtgattctctaccccaacgcgacgctggcattcaaccaagcggacaaggagcagggacgcattgcacggctgaagggaaaggctttcttccgcgtgaagagactgcacggcattcctttcaaggtggaaaccgaaaggctggacgtggaagtactgggtacatcgtttctggtaaatgctacggatacggaacagaacggcgtattcgtcaagaccggaagggtacgggtaagcgacaacgaggacaatgtggtgattgtggccaacgaaaaggtggaactggaacagggaaaactgaaggtgggcgtgatagacaatccgcagcagctcttcggacaagataaattaatgatgatatttgataatgctccgatacagcaagtggtaaaggagattgaacagaaaacgggtatacggatcgatctggacaaaggactggaaaagaacctgatcactacccggatagacagtgacaacgatatggaaatagtccgtgaactggctttcctctgcggatgcagctacgaaatggtggaagaaggaacacactacagactgtacaatgagtaatgggtaaactgaaactgtgcctcatactggcggtaactgttgctttatgcggaatgaccggagtatacggacaagagtccggaccggcgcacacggtagcagaagaaacgttgcaagtcgacgcttcttctgctactgtgcttcaatggtttcaccggatagagcgcgagaagcgtatcgtgctgtcgtacaacgcgtcactcatcgatctgaacagggtgatcagagttgagaaggcacggcggatgacggtggccgaactgctggaggtggtgctcgacggatatgtgttcaagacggacttcatcccgccgcgcaagctggtgattcaggtgcgcgagaaggagaacttctacgtgagcggaacggtgttcgaggagggcagcaaggaacggctctacggggccgtggtgtcgctggaagacggcaagggaaagcagtggaactgtatctccgacggaaacggggtgttcaagctgtatgcaccggagggtacgtacaggcttacggtatcgtacatgggctacagcccgtacaaccggcaggtcagggtggacaaggaccgctttgtcaccgcacagctgcaaccgctgtcgttcgagatggaggaagtaacggtggaatcggaaaagcggagcgaagagctgggagaactgacgccttcgaacatgcttgccttcagcgggaatgacctcttcgcccagatatggattctgccgggggtgacttcatcgatggcgggaagcaactttcaggtggacggcggaagctccgacgagaaccagttcctgctggacggggtgccggtgtttcatccgggacatatcaactcgctactgccggtattcaacggcgacgcggtgaagaacatggtgtttcacaagggattcttcgatacgcatctggagggaagactttcgtcggtgacggaggtgaacctgaaggaaggcaacaagcagaagcatgtgggtacgcttacgctggacatgccggctgcctcggctacgctggagggacctatcatcaaggacaagctgtcgtacatgttcagtgcccgaaggagctggctggatttcttcgaccggctgttctcggaagacaaccgcctgaaccatgcttcgtacgactacaatgccaagctgtcttattccctttcgccagtcagctcgctcagcttcctggcctacggagcacgcgacgactatcacttgccgctgctcagtgaagacgagaacacgtcggtgctgcgctgggagaatcaggtttatcagctgacgtaccagacgcaggcgggaaaactgggcaaccgtacctcgctattctactcgtcgcattccaaccgggcacggagtgagatgctgggagtggagggcgacggatacatccgcagcggcatccgctcggtcaacgtatcgacggagttcgactatacgttcgagaatatctaccgtgcgcagtggggagccaaatactcgcacgaggtgtacgaccttgcctcgttcgacggacaggaggcccttcgccacgaaccggtgactcaggcatcgctcttctacgacaaccatgtgcgcatcacgccccgcctctcggtacagataggcgttcacggcgtagcctacctgccacgcaaccaccgctcgtattacagcatccagccacgcatgtcgctgaaatacttcccgggcgaaaaagacctgctgtacctcaacttctcgaagatggagcagttctaccattgcctgaggctgttcagctgggacatgcctaccgatttccgcatgcccagcatcgacgggtacaagccgcgcacatcggaacattacgaggcgggatggaaacatttcctgaacaacggaatgctggaggtatcggcctactacaagacacggcgcaacgtggttgccctgcgtccggaggtgttcgtggaagacggacagtggggagagtatatcatggtgggaaaaggcgacagctacggagcgaggatgtacttctacaaggactggaagcgatggaagctgcaactgtcgtacacgtacgcacggacgcgggaatggtttcccgaactggcggccaacggcaagatgccttcgctgtacgacataccgcaccagctgaatgccgccctgtcgtaccagttgaatgcccgttcgctcttctccgtgggaggcatgatgcgctcgggcaaggtcatcgacctcgacgagaacttcgacccgctgcccgcctcggagttcagacagcaccgcctgccgatgaactaccggatagacgtgggctattcttaccggaaagcgttcggcgaaaaactcctgtcgctgcgtttcgggctgtataacgtactgggaaatccgcccgaagaggatgtgctgaacttctactccgtacactggaagagcaactgcctgccctatgcgggtatcagtttccgcttctagtacaagtacgaacgctacgcgctcacttcatgcgggcggcacactcgcggcacacccctttcaccatgtagttgatgctgttcaggcggaacccctcgggcaggtcgatgacggggatatggatggagcggaagcagaacgtgcggtgacacacctcgcagtagaaatgcgtgtgcatgtcgtctacgctgcatgtatcttcgtcgggacagacctcgtacttgagcgagccgctgccgtcctcgatgtcgtgcaccaggtgatgagccaggaacaggttcagcgtgcggaagatggtagagcggtcgacggtggcaagcatcgtttccagctcgatgagcgacacggcacacgaggcctccatcatcgccttcagcaccaggatgcgcacggcggtaggcttcacgcccttcttttccagcctctcggcataaatttcatttgtttccatgacgtttttagtatttttctgcgggtctttgcggcaaagatacacatttcctattgcaacccggttgcatccaggtcgcccgtataatggataggctggcggttgcgcatcgacacatggatgttcgacgagccgtcgtcgtagacatcgaccgaaaactcgaaattgtcctcgctggtagtggcctcgaagtgaatctggtaacggtctttcttgaactcgcaggaataattctctaccggagccttgaagcgcagtccctctcctcccccgtaaggaatctggtaagccctgccgaagtacggcagacagacatccacggaatccttcttcatctgaagtccgtagggggtagacagcggaatgctccttccgctcatggggtatgccatgtcggcatcaatcttgaaggtacgggcttccacctgctcgtcgacgtaagccttgagctcctccttcttctcctcacgggtctgcgccaccgacgtacctgcccacagcaggaagagcgcggccatccaaacaaatcggaatgttttcatatacgaatctcctttctgaaaaaaatctgtagattgaacaggcgcaagataaacaaaaaaaatctgttatccatccccacggcggagaatgaacaacagatttaatttaaattcagttatataacattaccgaacctgaataaccaggtagcgagatacactccagaactggttaggattggtaatcttcagaataatctgtcctttgtcgtctttggcaagttcgtacgaaccggcaggatgagtagtcagcaaggtagcacgtttagagtacagcttgatttccttatccttgcggatatcgatttctgtaaagtaatccttgttgaactcgttgtccttcagcacatcgccacggttcagaatcttctggtcctttaattcagacttggtaccgaatacataccatgcagtgttgagcgccttgtcctgagcggcaacggtctgagccttcgcctcgttttcggcagtcagctggtcaacgttcttgttcaggtcggaaacagcctcatcgagttcggcgatacggatgttcttagaagccagttcagcctgcagggtttcaatctgacgctgtttttcttccagctgtgcagtcaggttcttgatagccttcttgagctgtgccgactggtagttgctattcttgagctgcttctccagtttggcaatctcttcgcggttcgatttcagtttctcgctgatgaaacggatatcttccttaatcttgtctgcgctcgatttgttttcgatggcatcgcctgtaaggtcgacacggttttcagcttcgttgatttcgcggaaaccttcctggatttcattgaatgaacccattatttcatccagttcggcatcacggtttgacagctcgaccatcagtgaatcgttctggagcttcaacgcgtctttactctgaccggaattgttgcacgaagcaagtacggccgcagcacataacgaaaataaaacaactttcttcatagtttctatctgtttagaatttataaattattcttcttttcccgccagtacgataacgatttcccctctcggctcgttggccgtgaagtgtgtcaccacctcctgcaaggttccccgtacactttcttcgtgtatcttggagatttcgcggcatacggaaaccttccgttcggggccgaacagctcggcaaactgtgtcagtgttttcaccagccggtaaggcgactcgtagaaaatcatcgtgcgtgtttcttccgtcagtgcgttcagccgcgtcatccgtcccttcttctgcggcaggaagccttcgaagcagaaacgttcgtcgggcagtcccgaagccaccagcgccggcacgaaagcagtcgctcccggaaggcactgtacctcgatgtcgtttttcacacattcacgtactacgaggaagcccggatcggatatgcccggtgtccccgcgtccgataccagcgcgattgtttctcctgccttgaggcggttgatgattccttccacaatcttgtgctcattgaacttatgatacgactgcatggcattctttatctcgaaatgcttgagcagaatgcccgacgtgcgtgtatcctcggccagcaccagatcggcctccttcaatatacggatcgcgcgaaaggtcatatcctccaaattgcctacaggagtaggaacaacgtataatcttcccatacaatgtttcaattgttaattgagcaaagataggaagtttttaatctcactagttaatttgccccaatatttaacagttgttgtatattaaaatagcgaaaaacggaaaattcggacagaagataaagcttattagcatcacaaattgtatttttgcacaaaattttagaccaatggttgttttttcagaagatcatactcatgaaacctgccgcagaggaagaatagaagtcatctgcggttccatgttttcgggcaagaccgaagaactgatccgccgcctgaaacgcgccaccttcgcccgtcagcgagtggagatattcaagccggccatcgacacacgctattcggaagaggaagtggtgtcgcacgacaataattccatcccctctactccggtagactcgtcggcaagcatcttgctgttcagttcggaaatagacgtggtgggcatagacgaggcccagttcttcgacgaagggctgataaacgtgtgcaacgaactggccgaccgcggggtgagagtcatcattgccggactggacatggactttaaaggtgtgcctttcggaccgatacctgccttgtgtgccatcgccgacgaagtgacgaaggtgcatgccatctgtgtgaaatgcggtgacctggcgtacatctcccaccgtaccgttgccaacgacaagcgggtgctgctgggtgaaaaggaggaatacgagccgctgtgcaggtgctgttaccgcaaggtactggaggaggaagggaaaatctgatcttcccgattcgggcgtagccgtccggttcaggagaacgcgcccgtaagtacaatgtatttttacaaagcgtgcgccgttgaaaatcagcaatatgtaagaacagctgaaaattatttcaaaaaaatatgccagaatatttggcagattgatacaaaacatctacctttgcactcgcaatcaggaaatgactgcaaaacaggtttgattcgctagctcagcaggtagagcacaacacttttaatgttggggtcttgggttcgagccccaagcggatcactcaaacaaaaagcaaaacaatgaaaaccgctgataatcaatcattattagcggtttttctttttatccatactgcaaattgaggcagaatacgccatcccaaaggaggtgaaataggtggacttgattttcacttaaaaaaagtccacctatatgtatcatatttcactgattctctgtgtcttgcatgatgcaaactcttttcaaaacatgtaattttacaccaactaaaaaacaaagagtatggcaatgcaaagaaactattttacggtattgtttttcctgaaaaaatcaaagttacttaaaaatggagaagcaccaatctgtatgcgtattacaataaacgggaaacgtgcggagatccaaatcaagagaggcatagatgtcgcgaagtggaatgcgcaaaaggaatgtgcgattggcaaggaaagaaagtatcaagaaataaaccattatcttgatacaataagaactaaaatccttcaaatacaccgtgaacttgagcaggatggtaaaccaattacagcagatattataaaaaatatctactatggaggacactctactcccaaaatgttacttgaagtattccaggaacacaatctggagtaccgggaattaatgaacaaggaatatgccgagggaactgtactcagatatgaacgtactgcaagatatttgaaggaatttatcagtgaactgtataacttgactgatattccattaaaatcaatcaattatgaatttataaccaagtttgaacatttcattaagatacagaaaaactgtgcgcaaaatgcgacagtgaagtatctgaagaatttaaagaaaatcatcaaaactgcattgattaaaaagtggataactgatgatccgtttgctgaaatacatttcaaacaaactaaatgtaaccgtgaatttttaaacgagactgaactacgtaagattatcaacaaagattttgatattcagcggttacaaacggtaagggacatttttatcttctgctgtttcacaggcttggccttcacagacgtaaagaatctgaaaaaggaacaccttgtacaggcagataatggtgagtggtggataagaaaagcaagggaaaagaccgataatatgtgcgacattccattgttggatataccaagacttattttagaaaaatatcagtcaaatccaatctgcaatgaaaaaggattattacttcctgttcccagcaaccaacgaatgaacagttatttgaaagaaatagctgatgtatgtggcattcaaaagaatctttccacacacatggcaagacatataatttactattacttattgagaataaggaatttacaagatttattttttagacaggtaacggtttggaaacgagtagacttcttcaaatcacctgcttttgcataaaataaaagaacacttatttcagaatcaaagatagaaaaattctctatcatagcaaataatatactgagaaaaatctcgtgaaataacggatacaagattaacaattaatataaatgttaatgatgcaaacttcattttgtatatccttcaatctatcttggtctaatttcaattttttaccattaactacaacataattttctcctaattcacttatatggttcgcattaacaatacaattctcgctaatagtaatcattttatttagtgacattagttgttttattgcttttttaattgggatacttaaagggaaagtcctttgctcagatacatagacaactgaagttttatcgtctccttctgcatacaaaatttcattagcttcaacacaagcatacccttctttatcttcaatcattgcatatctttttctattagtttccttaattgatttgcttctttctgctttaatcttacttaagatcacatttttctgcctcattattgagtgtttattttttatttttctgactttcttcatatcctattcaagattaaatgcatactgactatattaagaatcgtaatccaatgataaatagctgaatatctttgatacaacattttgttaaagaagcaatcttccattattgcttaaccagattcttacaatattttgcagtatctcgcggagtcgattccctgttactctacaaatgtaaagctttattttgaaatacaagaagatgctttgtttttttgctccactattagaaggctaatacagctatttcccaaatcgtccagtataatcaccaggtgattattggattgaacgtaatattattagaattttatcatatattattctaccatttacctaataaaccctttttagagattaatactaatatgtttcatatataaatattttctttcaatactttaccacacatttaattcgattttacaattctcgtaagttaggctgctttctacaatcttgaagtggttattacccttgcgatgagattcaatacctataaattaaacagagaataatgcaaatggtgttggattgtttatcccaaccccaaaaggcgggaatcaaccgatgctttgcatagcaaagcagcaggagtgaactttgtcgtcaatttgaacaaaataattagcaatggaatcgcaatggtttcagttctattcaccgaatatattaatgccaaattaccgaaaaacataaatccaaataaccgaatattagaattttcaattacctttgtggaagtaaatagtttgatttatggatggttacaaacttagaataatggatagcctgcttgaaaaggctttgcaggcaaaaggagcggtgttgatagaaggacctaaatggtgtggtaaaaccacttcagccaaggagattgcagctagcaaaatattgttagctcgaactaatgtaaaaaataatttcaaaagcctgttagaaatagatacagatgcggcattgtcgggagatacaccaatacttattgacgagtggcaaactgtacctaaactgtggaatgctataagatatacaattgaccatcgccgtaaaatgggacagtttatattaacaggttctgccgttccagataaagataccgaaaatgagagaaaatattcaggaacaggttgttttgcttgtttgacaatgcgtcctatgacattatttgaatcgggagaatcaaacggtaaagtaagtcttggaaatctattcactactcctgataaaatactggagaagaatgaacttagattacaagatattgcattcttgatttgccgtggtggttggccaatggctgttgggttgcccaatgtggcggcattgaaacaggcattcgattattacgatgcagtaaccaaagaggaaataactaaagtagacggggtaaaaagagcatcagagcgagtacaacgtttgatgagagcatatgcccgacatcagggaacacaagcatcaattgcaacattaaaggaggatttaaaaaacaacgatacaggcacacttgatgatgatacaataagttcttatcttaatgctctacgaaagatttttgttgtagaagatatgccagcttggaatccaaatcttcgttcaaagacagcaattcgtactgctgatacacgctattttgtggacccatctatcgcaactgcagctttaggtttgggtccagcagatttaatgagcgatttaaagacaatgggattcttctttgaagctatgtgtgtaagagatttgcgtgtatttgcagaagcattgaatggaaaggtatatcattatcgtgataaaagtggtttagaatgcgatgcggtagtacatcttcgcaatggccaatatggacttatcgaagtcaaactcggaggcgaaactttgataaatgaaggagtagaaactttaacttcattaaccaaccaaattgacactgaacgcatgaaatcccctgctttcaagatgatattaacggcaacaggcgaacatgcttatcgtcgtccagaagatggtatttacattgttccgattggatgtctaaagcagtaatttaaaggtaacaaaagatggaaaaaataaaaaactttgatataataatcaataaatgtctttgggaaataaatccaacttcgacgactcccgatctagataagaacgactttttattatctgttataaatggttttgaagaagggaagtggagaaaaaacgaattccataagtttgtgatgaacaatatagcccaaactggattgtctgcggaagatagggataatctttattcggaatctccatacacaacaataacagagtctattaagaatcttcgtttagttgataaagacaatggtaaaggtagtgaaattgcagaaattgttttatatggcattatgcgttatcactataatgctcttcctgttgttccaaagatattttacaagcagaatcctaaagataatgcgaaaggagctgatagtgtacatattgtattagacgggaaaggggattttacattatggttaggggaagcaaagttttacaatgatatcacagatgaaaggttgtatgaaccaataaattctatctttgatactatcagtactgataaaataaagaaagaaaattcgattataactagcataaaggatttagaatatgtaattacagagcctactgtaaggaaaaatgttcaaacaatacttcggcgagagactcctattgacgaaataaggaaaaggctacatgtcccaattctattgcttcacgagtgtgataaaacttataatgcaacagggttaacagacacttacttagatgaaattaaagagtaccatctaaatcgtgccatccgcttttttatgtcacaaaataatcggcaattaaaagaaaacatttatggctatgaggatatacaatttcatcttattctttttcctgtgccccagaaggatgaaattgtgaattggtttgtagaacgagcaaaacaaattattgaagatgcataatattgaaatatttgaagaatgtgctaaaataaatagattgatagaaaacagcaataaggcggaagcacgttctttagtgattaatttattggataaattacagaaagaacaaattgagtatacccctcttgtcaatcatttgataagagaggtagggctatatccatatatagattgtaatacagcattatgggaagaccaagttgtcgtagaagcctttaaggccaatgtgggtgaagaaaaaccagttacactacatagtgctcaatctcgtgtactaaaacgacttttagccggagataatattgcagtaagtgcacccactagttttggtaaaagttttattatagatgcttttatcgctatccgtaagcctgaaaatgttgttattattgttccaacaattgctcttgctgatgaaacacgtcgtcgaattgagcacaaattctccctttattataagataattactacaactgatgcgacattggcagagagaaacatcttcatttttccacaagaacgctgttttgcttatattggcaaattagaaagtattgatatgctcattgtggatgaattctataaagtaagttctatgtttgatgatgaaaggagctcatcactattaagtgctattattgagttaggaaagatatctcgtcagaaatattatttggcccctaatattcataaaattgcagataatgtttttactcaagggatgcaatttatgagactagtagactttaaaacggtaatcacaaaatcagccaaaatatatgaaagattaaagaacggagaaaatcgagatgagtttaaaaaacgttatcttgttcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgcttgttaacatcttacaaaaaaacaaatcaaagacattgatttatgctggtagttatggcaatatcaataaagttgcagatattcttgctaatagtttgactcctaaaaagacgacactacttaaagattttaatgattggcttaaaataaattatggtcaagacttctcattgtgtaaactttgtgaaagaggtgttggtgtacataatggtaagatgcataggtcattgagtcaaatacaaattaaattatttgaagtagacaatggtctagatacagttatctctacatcttctataatagaaggggtaaacacacaagctgaacaagtcatagtatggtctaataaaaatggttctaacaagtttgattattttacatataggaatataattggacgagcaggccgtatgtttaaatatttcataggaaaagtttaccttctcgaagagcctcctgcacaagaagatactaccttaaagattgattttcctgaagaagttgttgaagctttagattcggaaaatccaggtatagagatcaatcaagagcaaaataataaaatcaaagactatgagtcatatatgacagatacattaggtgttgataattttaatcagataagaaagctcccattgtataagtcatgcgatccgcgtattctaaaacgattagttgagaaacttaaagctaatcctaattggcccaatgggtattctgcattagctttaccgaacacatataattggcgcgaacctataatggatgttataagtctacttggtgataatatggctcgtcttattaagattgctatttggaagatgcctgataattggaaacgttctattgctgatatatactctgaactttctgatattagttacgaagacctattttcagcagaacgatacttatcgtataatttatgttctacgctttctattataaatgtattaaaaaaattattatatcccgagtctccagacatatctggattcataggtagagctgcaaatgcatttttacccaaacttgtatatcaattagaagaatatggattaccgaggatgatttgtagaaaaattcaaaattcaggtttgattaattttgaagatgaatcaatagaaatatcagaaattattaatcagtttaatattatcggtcaagaaaaacttcttgaaaatttgaaagacattttgccatttgacaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgatttgataaatttattattaattatttttacgaaggaataagttaaaaataagaaatcaacaaggcgcaataaacgttactcagaaagcattggttaaaattataaattatgtgttcaaataatatagaaaacacccaagaatcttatatacaagttctacaagctaagcatggggacgcactcattttgtgttgtaacaaatctgataaaagaggagtcatagttattgatggaggaccttctcctaatccacgttttaacccttttgtaaaagaagtggagaattgtcttccaattgatttaatgatattaacccattttgacgatgatcatctagttggaataaaaaactttatcgagagacatcaaaatgatgttccttttcccgttaaaagaatctgggcgaactgtgcaaagcatgttgattttgacacttcagaaaacttgtcttctaacaaagcaagcaagatggctgatgtcctatgtgcaatatcgcaaaaatcagaacttgattgggaatcataccggttggatggatttgtggatgatactataacttttgccgatatagatattatcaatcctcgaaaagaattatttaagtattttattgataattataagaaagaatgtaattttagagactctgaagagaatttatcaaataggaaaaactcgaatttagatatctacatagatatgcatgaattggcacaacgtggtaaaactttaggcaatcaaaataaaccttcagaacttgtaaatatggtttcgttaagtatgttaatacgttgtgacgcatttagcatattaatattaggggatagctttccgcaagaaatatacatgtctcttattgaaagaggatacagtaaagaacataagttgcaagtagatttcataaagatgtctcatcatggcagtgctaataatatcagcaatgagttattagatattatagattgtgataaattcatcataagtactgatggaagtaaaggttataaacatccacatagagaagctatagcgaatgttttatgccatccagaaagagattactctcgtactattcatttttattttaactatccgcttaaaactataattaataatagagcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgatagagaagaagctttgtttaattttgagttagataaatgtttaaattttgaatatcatgagccgaaagaaattaatagattcatcttgttaccctgatatagatacacttcaagcattatctgtaaagattaactgcattaatgagcatgaagaaattattgaaaatggaacaggaactttgtttgcaaatgacggttcttattatgttataacagcagcccattgtattcttaataatactaccaaaagcttctatgataagagatgtattcagataagtcttcctcatatatgcaaaacctttatagaggtggatgaagttttagagttcaattctgatgatgatacagatttcgctcttttatctgttaaactagatattgatagtttcccgataagctttgattatgaaaatgatattcaatttgtaggtaaagacgagttttgtactaatacatgtttctatggttatacatcctcagaaccaacagggcgtatgtttcgtgccaggatggtatctacaaacacatatgaagtagaagaaaatacgatatctgcaacgggtgcagatttttctcgtgtaatgaaaggaagttcgggtagtgggatttttgttgaatacgagaaccgaatattttgtctgggctatgtaaaaagtcgtatgacagagacagacagattaaacgacattaaaatacgcagaatacctagtgatataaacaataagttctcgcatcccattctgctacattctattcaacagaaacaagcactagaagcgtctcttactcctcaatctcatgttgagattgaatacataaataaatggaatgagttaagcatcgccttatctaagaatgaagatattaccagaattcttaatgatattagtgaattaaagattcactatccatatgtaaagtcagttatatatcaagaacaaataacaaatatcatattaagaaacaagaatcaatggaatgcttgcgaacgacgtgcatttatttatgcattacaagatcgtggactatggcctgctttattcggagaactccctcaagctggcgacttcaatgatattcctgaatataagaacatgatgtttcgtgcatcaacttttgcctgtggatttactgatgaagcaaatatacctgataaaaatacagatgagggtatgtacgatttagttctttgtaaagcatttaagtttgaatttgacaagatgttcgaactgattaatgcttggaaagctaatggaatatgggctgtaaaaaaagcactacttgtacatttatttataagagatgaagacactctgaattcagtaaaaatgtttatcgagaataaaacgaattctgaaaacgagagatttgtagccactcttatatataatattgcaagccaacaatttccacaaccatataaatatacagaattttgggaacatggtgtagaggaaccaagtgagataatctcatacattgcagcaagaattgataaaacaaaaatacagcctcatatctttggtactcattctacgcaaatttttggaagtacagattctacttcttttcctgaatctatcagattgttacaatatttggcaaatacaggtttaacaacaaaatttggtatttatagtattgtaaatatagaacattggatgaaggcgtttcgtcacttggtacacttcatcccttaccctacagtttattatacattgcaatatgctgaagagaaaactgtaagatgggcaggtcagatgatagcatatagtgatgatgattttttaaccagtgttcgtccaaacttacttaatactttattaggagctttaagaattgaatgcactcctagaaacttatatgcaagcatttattatataacccaagaattatatgtatctgttgaagaaagtatatggtatgatgaatttaggaaatctgttttagattattttgttggagaaatagatgcagcaaatgtaagtatgtcggatgctatctataagaacttattttctgctattcaatgtgttaaagaccttgaaagaagaaaggaaatatttattcaattagcgaataaaatgtcacaaaatccgcatcttattagtcgattattatgcaatgcattgttagtagatatagaattggcagctactccagaagtaaaagaatgtttatgttatataatcgatcaaattcctatagcttgttcgtatcatattttatacgagtttaatcgaattaacacattgactgcagagcaaagaacagcaatagacagtaaaatattagccgaacaattatcattttcaaaaagtgattatatagccttagttaatttgagtaatttagctctctctgaaaaaagtatatctaagataaaacaaatagctctctctaatgacatatggaattgcggtatcacagattcttgttatacagctccaatgccatcacacattgaactatttgacgataaagtgatatggtcagaagaagaatggcaatttattcgattgaatatggaacaaaatatagagctcttagaaagcaaaaagattaaaagagagtcttcaaatttcttcaattctatgtaccttcatcttctttcagacatgaaattatttatactacgattacaaaaaactaatggatttaatgtagaagatatactttatagagttaatatgctgaaaacggttgatatccgttcacccaaaacggtgatatccgttcacttttcatcctctaaacctatggcgatgcaaatttattgattttcgtctgtaatgttatattttggatgttttttttgacgcatactgctgccttctaactcgaagcgcacacttgtgtgcaccagcctgtctaatattgcatcagccgcagtcgtgttgcctttcatcacatcgtaccagttagcaaccggcagttgtgatatgatgatagtagctttctgtccatgtcggtcttctataatctccataaagtcaagcagctgttgtccgtcaagaactttcataccgaagtcgtccagtataagcagatcagtctgtgccaacctggcgaagaaacgatgcagggtactggatatgcgggcaaggcttatttcctcgaagagcctgtacaggttataataggcaaccttatgtccgttcatgcaggcctgatgaccaaacgctgtacccaaccagcttttacctgtaccggaagctcccgtaataagtatggacaccccgtttttcacatagtcacaagtggcaagattaagcactttctgcttgtctacgccacgcttgctgtcatatataacttcacttatggaagcgtgataacggaagtgtgctttttttatcagacgggcattccggctttgattccggttatccagttcggcctgtataagcagttgcaggccgtccttcaaggagagcgactctgcctgtcgcgtctcctgcatcgtagcccagtaatgtgccattccgggcatcttaaggtttcttagagcattgataatttcatccatcgttattggttttgagtgttagaagtctgtcatttgaactgtgatttcccacggatattacagtgttgcggaggagcaaaggaagatgtaggctgccccacaccggcacacttgctttccaccagtgagcgtataaagcggtaactgcatctgtctacgttcagggctgtctcgcaggctttctggaaaacggccggatcactgctcctttgcaggtttagaagcccgtcgcaggtcttgtaatgagtctccggaggcattgtggaagaataaaatatgcggcggattacatctccaagtatgccggatgcacgctcggcacgctctatgtatgattttgcactcattcctctgtattcccgggagttgcttgcaagatgctcctttacaatagtatactttcccctgttgtaatcacgtatgtgagtggctacaagttcaccgtccacatatacttttaccagtgtgcgtgtatatgcaacatgtgcagttttggatatatactgatacggcactgtataatagtgctggtcacgtccgagatagatacagcagttggttgacaccttcaaatcggtatatgacacaatctcaaaatccctgtcaggcagcggcataagatttggcctgtctacggcaaggaaccgttcctcacgcgtgtaaggatgcttctgcatgcgtttctggttgtgcgctttcattttgagcgaggctgcccggttaagctcttccagtgaatggaaggtttcattgcggagttcggcaaacacacgcatatagacaagcctcacggtcccttccacgttgcttttatcttttgggtgtgcgggacgtgccggtatgatgaccgtgccataatgattggccatatcctccattacacggttaagcgaaggctcatatctgtctgtcttgacaacggcagctttaaggttgtcagggacaagcatctttggtacgccgccaagatgtttcaggcactgtgttatggcatatacaaagtcttccgtgcgttgtgaacgtacgaagaggatataaccgtagtcgcttgcaggcagagtggctacgaaagcctggcactggacgacctcaccggtttccatatcaacgtatcccatggtatcaccggcaaaatcgaggaaaagcttttcaccgccagtacgcatgtcagcaagtatggtagatggcgattcctttccggcctctgtgttctgtttgtaatgaaaacggaactgtgtcaggctgtagtggttgtcaggatgctcattacggtattcctcccaaagaagcttcagcgtgacatgcttgcgcttcatctcctcctgaagatatggaagaagggttttgaatgtttcaaagcgtttgtcactatatgcaggattgccgcccttgagacggtgctcaagaatgggatcgtccagcctgataagttcatcaaggctcaggctgtcagcgctgaccttgttcatgtagttgttcactgtctccttgttcatgccgattatatcggcagccttgcggttggagactccattcttctttaatagaagaagttgtttgatctggctcatattcttactttttcctgccatagtcgtattgtatgaagattatattctgcatacaagatacgggaaagagtggaaagtgaacggacatgccccgttttttatgcaggcatcgtcgtttctatgagaaagtgaacggatatgctccgttttccgaatgtaaacaactgattattgtattattacattcccatcactgaacggatatactccgatttttgtatagtaaaacggatattttatcgtaatcacaaaccactgaacggatatgctccgttttttgagcgactttgggcattttttagcaaaaatgaacggatatgctccgttttttatgcccttttcaagcccattttagcaataattgtgggtggattatgccgttctaagtgggtgggtatgctccgttttcgccacttgactatgacaccgtatggaaggccatttgtcacaagacaggtaacctgcacgacattttcaattcatacgggcattacgaatggttttcaaaccatgcggatgattacatggctgacaaggctatggaacttgatcccaatctgtttgacagacttccaaaacaatttcggacaccggaaagactgagctataccctgagcgtgaaaaaggaaatcagcagttacagattccatatcgggccggagctgatgacgaaagaggtctgtatggcactggccagaagagattcgttctatccagatattccatcggaacgctggaacaaggaacttgtggaatatttcaccgaatacggccatagtctatactggctccctcaactgccgaagaaactacagaccagaaaacttgccgagaaggttctcaaggagaagccgcaatacttccattatctgcggatggaattcatcacacctgaaatgtccaggcttttatgtcaaaaagaccaggataatatccgtcatttcaaggagcgtgtcatggagttccagaaatatacaggacttccagccgaattctatggatgtgaaacggatttcgagcatatcagggaccgtaatgacagccgccgatactgccgtataggattcacttacattgccctgcaaaaatgtaaacgcggatggcatgaaagtgaatactatcttatcatgacacgccatcccaaccgatatatgcctgccgaaacagtgttcagaaaacagattaccacattccaccggacatggctggaaaagacaatatgtgacaacgatccgcaattccagattccgaagattcaaaagaatttgaaggatgtacaggccatgcggtattatgaggtggaacatatccgtaccatactgggttgtgaaatataccgcaactctttcatggggcaaacagtggaatactgtatccgcaaggacgggctgacctaccatgacaggaacatggaaaggctcgcctccggcctgcaatacaagatcagtcagttgaaggagcaggctgtactccccaaagatactgatgactctatggaaatcaacgcagaaacggtacaccgcaatatggggtattgtctaaccggaatagaagcttttgcggaagactacggactggacgtaacccggacctatactctgaaagaactgaaggacgttatccatgaacagggatacaagccttcactggagaaatacaaaaaagaagtccaacatctaaatcttatttgaatatgaatattttccaaaaaagaattgaaaacctgtgcgatgagatcatcggcaggatacttgcactgatgcaggcaaactcggtttccgaagtaatactgacagacaacgacaatccggtctacgtaatctggtttgacaagatgggtgatccgtgcgaatgctccgtacacaaggtaactgtcgtcggagaaagaatcacacttgaagttcatgataagataaccggagaaaattataaggtcacaagccgccatgaggcggctttggccaatccgatatggcttaacgatattctggaagccataacaaatatcttccatataaaagaagatgatgttatatgctgcaaatgcggaagtacgaacgtaacctgtgaagcgatgataaatcccaatacaaaggactttgaccactatacagacgactcttttcagtatgggtggtgcgacaactgtaaaatcggaacagtcataagcgacacatctgaagtaaagaagggaatatcgcagaaatataaggagtttaaagagatttacaataccgaaccgcaacaggctttatgtcgtatcatctggaaagatgatatgaaagaaacggaagtttccatagcactcgaaaacattccggaagagcatgacaataccatcttcttctattgcgacagcctgtccgatttcatggcgttggcagaatacggaggagaagacttcatcgttacggaatgttttaactttaccaacttgggaaatgaggaataatttatttttatcttttcaaagttgcctgatatgtaaactttttatatatttgcagcatgaaacaggaacggaccatatcagcctacaagaattatttcatggactttatctcatctctcagaaaagaggaagcccgtaagatatactacattcttgatatgctgaaagtacaggaaagggtaagcagcaagttcgtgaagtatctgcgtgaagaactttatgaaatccgtgctgaatatggaggcaacatcttcagggtattcttcatatttgatgacgggaacatcgtaatcctgttcaacggatttcagaaaaagacacagaagacaccgccttctgaaatagaaaaagcattaaagataaaggaggagtattatgaaagtaagaaatgaaaacctgaccagcatcgatgctatcatggatgcggaattcggcaatccgggaacacctgaacgtgaggagttccgtaaggaggcatatgcctactgcatgggacagattatatgtgatgccagaaagaaggaaaagatgacccagtccgaactggctgaaaaaatcgggaccaacaagtcctatatctccagaatagaaaaaggtattgtagatccgggtatcagtacgttctgccgtatcattgatgcactcggattgaagattgaaattgtcaaaccggtattataatggaaaattatcaggaaaaagccagagaaaacttttaccgcaaccgtccatacggcattcacattgattatgcccgaaaaggatttgtactgttcaatcactatacaaacagtctcggcaaacaggaaaccggttctattgaaggacttccccttgaaaagttcgaggatgtggacgcgataccattgaacgggaaaattataaaaaatggtaaccggacaacagacatctatttctatacggacgattcaaatccttacaaaaacaagaagctggatatggatgctctgaaacagtataaccggttcatttatcccctgtcactttttttagacaggatattataacaagacagccgtgaatcatgataaattcacggctgtcttgtttctatggcacaaacagtaatctgtattcttcttttcttctcctttctattgacggaattttctttcccttatagtgacaatatcgtatgaagtccacataaatgttccggttaccggcttccagtttccttatcaacgtgcttttaggcatcctgccataaccgagcaacttatatggtcccacttggtatgccagacacgcaaccaaaagttatccaaaccaaaatattatcccaacttgactttttactatattgaatatcagtaaattgttatattttggtagcagataataaagagtgattgttccattattcaagaacagtcactcatttattactaagtattatctcaatccaagaactgttgctaatgaatctttatttctgattttcttatatttcttttcaacgcctaaagtcagattgtcttccatagagcataaagcttgtatcatttgttctgatgaaactcctacgtatttcattgtcgtttcaatgctctcatgccccaatagtttttgtatctgcgccaagtttacaccgtcttccaaccaatgggtagcccgtgcatgccgaaaactatggcaatgaaaatctacaggaatttcaagtagcccctgagacgcaatcctaacatacattttcaaccgcttgctaatcgcttctgaagtgatttttttgtttgcatggccatatatggggaaaaatacaaaatcagaaggtaacggatttgccggatggaacaacttcacataatgtctcagtattcttaccatgctgttcaacaaataaatggtacgttgtttattccctttacccaaaacaagaatgtaacctttcgtttcatccaggtgcagtgccgacagcctcaatgataatatttcatctattcttgttccggtactatatagaagattgaacaaggcaaaatccctcttacctatcaatgtacgtgtattgatgcttgcaaaaatccgtttgattgtatcttttgtgattacttccacttgttttttaggttgctgcattctttttatttcagcggcatcacaatcatattttatgaattggattttcttgtgcgcaaggaaacggaggaaatttttcaatatggagaggcgatgattgcatgtttgcgggctgcattttcttacttctttcagccacgcaatccattcttcaatccagtccttacggaagcattccccacaaagggtatttgatgtgactccttttgaggattcaattctctttatactattccggattcttgcggatcaacgtaaaacggggatcaacgtaaaagcctgaggaattctcaaatcacgcataaatttttgtagctagaacagaaggtcctgataattattgacagtccacgacttgacccgaaacctaaagattgtcttatcacctgtcatgataccaaaatcttgcttagaaaaaaggactaaacaagcagcgttagtatctggcccatagctacgcactcaatgcgcccaagcatttatttacaacatattggctgtcaaacaaatataagtacacatttacgaacttcttatccatcaatttaaatgagcctataaggtttttcataatccatcacgtacgtagaaacgtcgtttcctatattacctgtctttatccagacatgaaataaagaccacgccccagccaatccaaaagcctcagcatgttttcgggtatttctcccgatgtttttttattttttgtacaaaaaataaaaaaagaccggcacgaattttccagctctgccagacgtgctttccaccacttcttattgccccaaaataagtatatagattataaatagatatgctaggccatttcctaaaacgcttcgtatcttccggaatccgaaaacaaaatgcctgaagccacgcctcagcggttgaactataaaagtaaaaaatcaagaaaaaaagaaggggaatacattcctcaaaaagagcggattagatagatttttccattcatgccggtatcataaagttacagacttttctttttccggtataaaagagccggaaaacttcataaaaatacactataaatacattttctcgttttttctcctttttggttacattttcttcaccaaaatgaaataaaataaattattttttcatcttattgccattttttgtagtaactttgcgaggcaatgatattttaagacagatattatttttaaagagagggaaaatgactacaaatttttattcaacaaatcaatttttatacgaacctaaactgctttttcgcaacctgaagtcgagagatggcttctgacgcgattccctttattcatccagaaaccaccttgcactttcatcgacctgcctcacaggatatgcgtatcctcggcaagtgaaagtcctgcaagcgcacggattccggaactatttttataacttttgtttcctttggtctgccctccaaaatctttggtgaagatgctggagcggtttatgttggcgttatcagaatcataacagccaggtttcttatttccataaccggacagtgcctacaccttaattatataaggtaatccggaaaagacactgaagaaacgcaggcaagccgctcaagggtaccagaggaagcataccggatagagaaacgaataaacaactatttattaatcattaattttatattaacaggcaaaagatgaaaagattaagtctttggttactcttttttgcagtgttaggtatccagtcagcattggcccagacgtacaaggtcaagggtaatgtcgtgtcgaaatccgacaacgagccgctgattggtgtatctatcttgcagaaaggaactactaatggggtggttaccgacatcgatggtaactatgagctgcagatccagggtggtgaagccacgttggttttctcttatatcggtctgcaaacgcaggaattgaaagtaaacgcacgaaccggtgtgctgaatgtcgccatggaagacgactcacacctgatggacgacgtggtagtcgtggcgtacggtgttcgtaagaaaggaacaatcgccggttctgtatcgaccgtgaaaaatgacaagctggaaaacgtgcctgctccgagcttcgaccaggcattgcagggacagactaccggtctgtcggtcatctcaaactcaggtgagcccagcaaggctgccactttccagatccgtggtaccaactctatcaactcgggtaccgcaccgcttttcattcttgacggtgtgcctatctcaagctcagacttcaatacgataagtcctagcgacatcgagtcaatttctgtattgaaagacgcatcttctacctctatctatggtgcacgtgccgcaaacggtgtggttgtaatcactaccaagcgtggtctgtcgatggacaaggccaaggtgactttccgtgcacaatatggtttctctcagctggcacagaataactggaatatgatgaacactgccgaacgtatccagtacgaaaaggaaatcggaatcgatacgggaaaggattacgacgtgctctcgcgtacgaacgtaaactggctggacatggtgttcaacgaccgtgcaccgctgcagaactatgaagtttcggtgaaccgtgctaccgaccgcctgaactacttcgtatcgggaggcttctacgatcaggacggtatcgcacagagctctactttccgccgttacaacatgcgcgccaacgccgaagtaaaggctagcaactggctgaaggtgggtaccaactcgatggtggcttacgaagaagtggaacaggccgacgacggttcgtatgcgctgtacactcctatctcggcttgccgcttcatgcttccttactggaatccgtacaacgaagacggttcgctggcttcggaaaacgacggcacatggacaggaacgggttcgaacccgatcgaatggatggcaaacaatccggtaaccaataagaaatataaggtattgtctaccgtatttgccgaaatcactccaatcaaaaacctgactatccgtgcacagttcggtgccgacttctcgcactctaccgcattcatgcagtctttcccgagctacatcatcaacaacgaaatgggtacggcaggacgtaactcttcggacatgctgaacctgaccgaaacaactaccgtaaactaccgctgggaactgaacagcgaccactcgttcaacttcctgctgggacaggaaggcgttgattatcgctcggaaggttttcaggttatcaccaccggacagtcgaatgacttcctgacaaacatcagttcgggtacacgtgcttcatcgtgggccgactctacgacctcttattcgtacttgtctttcttcggacgtggcgaatataactacaaggatctgtattacgccgacttctccgtacgtgcggatgcttcttcacgtttcggtaccggcaaccgctgggcaggattctggtcgctgggcttcatgtggaacctgaagagcgaaccgttcctgaaagacatcgaatggttgagcagcgcacagatcgcactgagtacaggtacttcgggtaactcttctatccccgactacgatcatctggcactggtttcgggtaaagccaattacgaagatcaggctggtatctatccgtcgcagagcggaaacgaggatttgagctgggaaaaactctggtcgagcaacgtagctctgcgcctgggattcatcgaccgcatcaacctcgacatcgaattctataacaagaaaacaaccaacatgctgatgctcgtgcccgactcttacgcactgaccggtgaaggagaacactgggacaacatcggtgccatgctgaaccgtggtgtggaattcaacgtaagcgccgacgtgatccgtacgaaagactttgtatggagcgtaaacgccaatgcatcgtacaacaagaacaagctgctggaactctacaacggagtacaggaatacgaagtttctactactgccaccaagctggttgtaggacactctgtaagtgaattctatataaaccgctatgccggagtaaatcctgccaacggtgacgccctgtggtataccaaggacggacagattaccaacgaatacaacgaaggcgacaaggtgatgaccggaaagactttcgacgctccctggcagggcggtttcggaacatcgctggcatggaagggtttctcgctcgccgctcagttcagctgggtagccgaccgctggatgttcaacaacgaccgctactttgaagaaagcaacggactgtatgccgcatacaaccagtctaaacgtctgctgtacgaccgctggaaacagccgggcgacatcaccgacattcctcgtcacggagtcactcctcagttcgacgaccgtttcctggaaaatgcttccttcctgcgtctgaagaacgttacgctggcttatgccttcccgcagcgcctgctgagcaagaccaatttcttcagctcggcaagaatctacctgcagggacagaacctgctgacgtttaccggatttacaggtcttgaccctgaatcttcttcaaacgtatacaaggcacagtatcctatgtcaagacagtttacacttggtgtagaggtttcattttaattaatatagaaaagaaaaatgatcaaaaaaataaagaaatatttcatattgtctgctatagccctgcttgctacttcctgcctcgacaaatatccggaagatgctatccagcaggacaaggccatcaatactgtagacgatgccaacctggctgtaatcggtatatacgatgccttcaagagctcttatctgtactccggatacctgactctgctacccgacttgcaggccgattttgtgtatgccgtaaacggatattcgaatacctacggtgatatctggcgctggaaagacatccatcctaccaacgaacaggtggaagctgtatacggcgcactgtatggcgtgatcaaccgctgtaacttcctgctcgacaacgtagagaaagttaagaagtctatcaagaccgatgccgattacgaccgtctggaccagtactgcggagaggcttacttcgcacgtgcactggcttactcggaactggtaaagatgtactgcaagccttacgaaagcgatgaggacgcagccaaccagctgggtgtggtcatcaccgaacactacaaaggcaacgaaccgatcgtacgtgccaacctgaaggattcgtaccagttcattctggacgacctggacagagcagccgaactcctgaaactggaagacgactacagctcggctaccgacggagcgctgtacgactctccttacttcagcgaatataccgtacatgccctgcgcgcacgtatctcgctgtacatgaagcgctgggatgatgccatcaaatattcatcgaaggtgatagacgacggatattatgctctgtcaagctgcaatcagaatatctcgtcgggcgtaagctactataaatacatgtggaccaacgaccacgctaccgaaatcatctggaaagtaggattcaccatcaactcttacggaggtgcactgggtatgatcttcgccaactacgactatcagacactgaaacctgattatgtaccggctttgtgggtactgaacctgtacgacgcgaacgacctgcgtgccactaccttcttccagtcgtttactaccggctacgaccacggactgacctggccgctgctgatcaagtatttcggaaacgaagaattcatgaacgcaagcatccgccacgtctgcatgccgaaggtattccgcctgtcggaacagtacctgatccgtgctgaagcatacgtacagaaaggcgactatgccaaggcaggaagcgacatcaccaccctgcgtatggcacgttactcttcttacggaggttctacagccttgtcgaaagacaatgccatggatgtcatcgaacaggaacgtgtgaaggaactgtacatggaaggcttccgtctgaacgacctgaaacgctggcacaaaggcttccagcgcaagccgcaggaccagtcgctgagcaacggcagcagcctgaaggtagaaaaagacgatccgctctttgtatggcctatcccgcagcacgaaatagaagcaccgggagccgacatcacaccgaatgaaagtaataaataagttaaaaacatacgataatgaaaaaactgtttattggttgtatcgcagttattgctgttttgatggggctcgccggatgtaattcggaaagaactacttatgaaggtcccaattatcttatgttttccgatacgctttaccgctatgccgtacaggaaaccggagaggtattcaatgtacttgtctctgctactgttcctgccgactacgaccgtacgtttgccgttgaggtggtagacagcatcagcgatgcagtggaaggaaagcactacaaactgttgtcgaacactgttacgatcaaggccggcgaatgtgctgccaacgtacaggttcagggaatctacgataacattgacatcaatgagtatctgactctcggactccgactgattatcccgaaggaggaacagtggagcttgtatggcatcgatacgaaagtcgttctgcaaaaggcatgtccgttcgacatccacacctttacgggatattgcaaggtgacttccagctacttcgaagattatatgcagaatgtaaccatgcgtctgatcaagacagaagtaaatccggaaaaggaaaactctgtcattctgcacgacctgtattacaaaggacatgatatcgtgttggatttcgaccgcaagaatccgctcgaaccgctggtgagcatggacgaacaggtatgtggaactaccagtgaagctttcggtaccatctatggcgacggtaacctgctgatgtatcagcctacaatgtatacgtcttactacagcacatgcgagaagttcgtattccagtatgtcaccctgcgtgtagacggagtaggaacagtaggtacatacgccaacatcctggaatggatcagtgacgcagaagctgaaaaattaatggaagaaggatattaatcaaaacaaacgcaattcattatgaaaacactttatataaaaccgatttacctgttcatggtactgaccatgatgatgggttttacatttactgcatgtagcagtgacgatcctgaaggaacatcaacaactgttgaatttccggctctgaaagaactttcgggaaaggccggagaaaccctggaactgtcattctctgccggaagcgactggacactgagcagcaacaagggatggtgtaaattcaaagatggcgaatttactgaaacgactctctctggaaaagccggttcacagacggtacagattgtgatttccgaatcacagctcaccagcgaagttgccgaactgacactgactatgggcggaaagtcacaggttatctgcaaggttacttgtcaggaaaagcaatatgccgatctggtagtaactgatgaagaaggaaatgtatacgatgcagaacatccgctggtcatcaaaggtagcggactgacagacaacgcatacgacatcgtctacactaccatcaaggtggaatcggaaaagacggtcggtattcctgaaaagccggaatggatcgaggctcaggcttcgaccgaaactccgggtgtattccagctgacattctacaagaagtcgggtatttctgaaatctactctttcagcaatgcagatgacaagctggtaattgctacagaagataataaacagcgagtagaaattccggtttcttatgaaggattgagagaagatgtaattactttcaaggaaacagatctgtcgttcactcagaaccacatgacactggatcacaactctacttacttctctgtagccaacgctatgaccggtgaagaaacaactttctctcttccgctcacactgacggtagaccaggtaagaaacgatgagttcggttacatcatcggtcgcgtagatagagaagaaacttatcctaattactattcatatacttacgatttcgatgcaacgggtctggatagctgggttaaggtaagcatcaacaataagaacgtttctctggatgttgacaagctgacaggagatacagaaagaggtgccatcgtactgctgatttctaaagacttctgcgacaagtacaaaggacactacaacgatatgctgttggacgaagaaggatacttcagttcaacttaccagaacaatgtgatggtaagcttcacacaggttcctgaaaagaaagtgaccggcctccagctcaagggttacgtaatgatgaacggtacactgactccgttcgaaagtgttcccgacgatgcagccatgatcagtgactcaagcgacccaatgtttgaatatgccgacaagaagagtcaaaacttctggtatgtatcggctaataaatctttacttcagaacggaaacaagatttatctggaagtagtaggcgatattccttcaggctacagtattggagcattcaacgctataggatggcccaatacgcacacttcaagcgacaccattgatggtaagacatatatcgtaatatctggtgctcctactgataaagaaatcgcaaatcagcctgtcataactgtaggagtaggtaacttcgatatgggagactttttaattgaatgtggaataaaagtttggtgataatgaataaactacaatttaatatagtaaaactattgtttgtatcactcatagccgtgttttcgggcatggctatgagcggatgctctgacgatgaagaagtgaaccagagccagtacggctatgttcagttcaagctctacaaggaggcatcgtacaacaacggaacagaagctgccactcagagcgctgcaacacgtgctgcggtcgatagtctgggtcaagcaaagaaaattgaggtggaaatgctgtacaacggtaccagcattacacagactttggtgctgaatgcttacaacgatgaaaacgcggaatacggactgcgcagcgacaagttgcagttgctggtgggcgactacaagatcgtaggatacagaatctacgacaagctggaccaggttatcaccggtatatcggccgatgccgacgagatgtttactgtcgttccttccggactgacagtaaaagacctgaccatcgacgcacaggccagaggttctgtcaagttcaagctggaaaagcagttgcctcaaacacgtgccaacagcgaaggttatctgttcagcgacatccagctggctactattcaggtacagaacaccttcagccaggtaacttacaagttcgaaaagctgaaagccagatacgaagaagaatatgaactgacaaaccccgacagcgaaaacgacaagtacaaagatcacggggtagcttactgcgactctgccgtatggttgcctgctggtgactataaggtgatttcgtatactgtatacaccaaacagggtgtcacagaaaccgaactcgaaacacaggctgtcagcggtgaaacatttaccgtaaaagataaccagctgactgaatatgctatcgtaccggtactggtttcggaaactgccgaaaacatcaaggattatctggccctgaaagcaatctgggacagtatgggtggaaagaactggagctactacggagagacttatccgcagggtaccaactggaacttcaataaagatattgatatgtggggcgaccagccgggtgtaacgctcaacagcaacggacgtgtcacttctctgacattggccggattcggagcaacgggtgcactgcccgatgcaatcggtcagctgacagaactgcgtgtgcttgccttgggttcacacgacgaaacatacggcagctcattgtttggtcctaacggtattcagccggatatgagcgaagctaaacgcaacgaaatgcgtatggactataagaagcacttcctcgacagagacatacgtgccaacttgtcggaaatgttgcagtggagcatcgataactatgcttctcctaacaacaagatcaagaaagacagccgtatctcgaagaaggatacacagattggtatcttgaccaacggcattactggtgtatcgaaggctatcatgcgcctgaagaacttgcagcagttctatattgctaatgctcctatcacttacgataagatctgtaccgactggacagatcctcactcaacgtatgcacagcagtatgcaaaggaaaacctgagctgggccgacatgaccaacttgaccgacttggaattgtataactgtgcgaacctgactcgcctgccgctcgacatgataggcaatctgcccgaattgcagttgctgaacgtagcctgcaaccagggtatcactggtgcacagctcagagaggactggtctaaactgtgcgacatgcctgccggaccaaaaattcagattctttacatgggttacaacaacctggaagagttccccgatgatgcgcagctgcacaaaatggtgaagttcaaaatgctggactgtaccaccaacaaggttcataccctgcactcgttcggaacagacatcaagttgtctaccctgtatctggatcacaacaagattacttcaattcctgatgacttctgtgccttcaccaacgaggtagaaacattaggtttctcttataacgaactgacagaggttccgaacatcttcaatgcgaagtctatctacgtcatgagcagcgtagacttctcgcacaacaagattaccggatttgccggaggtgatgacaacttcaagggtatcaacgcttatacagtttcactgtcgtacaacaagctgaagaacttcccgaaagcactgttcaagtcgggttctcctatccagacactggacttgactgccaacgaactgacagaggtgaaggaaggcgatatgcagggtccgaatgcttacctgctggaaacgatcgacctgcgtttcaacaagctgaccaagttgtgcgatgatttccgtgcaaccaacattccttacctgaccggtatcgacttgagctataactcgttctcggaagttccgcctcaaccgttgaactgtagcgaactgaaggctttcgctatccgctaccagcgcaacgaaaaaggtgaacgtactctgcgcacctggccggaaggcattactcagtgcccgagtctggtacagttgcagattggttcgaacgatattcgtaaagtgaacgaaaccatgacaccgtatatctggattctcgacatcaaggacaatccgaatatctctatcgacttgtcgggtgtctgctcagctatccaggccggtatgtattacctgttctacgacaagactcaggatatccgcggatgcgacattttaggaatagaacgataattaaagaacaaaggaaatataactgattatgaaaattataaatcgattgatacttggactggctgttttcgctggaatcaccacatcgtgtaaggaagacgatgacgtgaacatcccgggcggtctttcgctcgacgtggaggaaatcacggtgggacccgaaaagtcattcaaagaaattttggtcaaggcagatgtcaactggcaggccagtagctctacaccgtggatatctgtatcgcccgccaacggaacaggaagcgcaacctgtgagctgaacatcgactctacactgacctatacggcacgtaccgcacaggtacgtttcagcccggcaggcaatgagccgaaaatcctgaaggtaactcagtttggtttcggaaagcagattcttctcgacaagccggaagtagaactggaaaactctgacatcgaagacaatcgttacttcgacgtgaacatttctaccaacgtgcagtttgctatcgaaagtgtagaatattcgttcgaagaagaagttccggccgacgaggaagcaagcatgagtgcttccgataaagccgactggctgacattgccgaaagaagaagacttgaacgtgaacctcgaccgtggttcacgtccgcgctcagtaaaagcaagattcaaatggaacatgaacgccgtaccttatactcgtgtggctaaagtcaagctggtagccaagaacagcgaagaccagctggtagacagcgacggtaacgaaattgatgcggtatacctcaccgtaactcagaaaccggctgtccgcatcgaagacaaccgtgcaggcgactctatctctattgtcctcatcacgcagaaggtacagtgcatgtatgcgctcgacgtgagcgaggacatgcgtaactgggctgatgtaaccttgtgggaagagaccgacgaagacctgcccgaagctgctgctgtaggacgtgtccgttctctttctatcgccatgatcgataccaaggaaacattgccgcaggaaatcaagaacctgaagtatctggaatcgttcaatatccagagcaacaccaaccgtcaagatcgtgaaatcgtactgggaccggaaatctgtgagctgaaacacctcaagaaactttctatcacatcgtacggtctggtagagctgcccgaagaatttgtcaaactgggaggagcaaccgacaagagctatgtgggtctggaacagctcggactgaaaagtaacaacttcgcttcactgagcaaggtgaccagtatcgtcaacaaggaaaacttcccgaaactgaaagtgctgaagctgtcgggatgcagacgtaacgataccatgctcgacatgtcgcagatggaaagcggatataaatggaaaggcaaacatgtcggtttgtatgccgacctcaccaagtcaagcgacaagaacgagttcatgaagctgatggaatgggatacgctcgaccagctggaactgtcttacgaattcatcgaaggcgagctgcctaccgacgaggaaatgatggctaaattcggtaactacagccagtatgccagccagcatcccgatgctgacgtatgcacactgttggccgatacttgccagtggctcaaaacatccgacaagcctgtaaccgtaaaatacgatggcggccagttctctgtaaagggtaccgacgtaccgtgcgtccttcctaataccaaggtgctgtcactcaacctgaacttcatgacaggtaagctgcctaactggatcatcttccacccgtacctgatagactggtacccggaatcgatgatattccagcaggaagtaggaaagaactccgacggcaaagatgccggatttgacgaagttcctatggatttcgattatttctacggaaagcagactaacgacccgaatgccgcattcccgaaatattacggaaaatacatacttgaggaagagatatctggagaataacacgtaattttaatacttaaacaagaatgaagaaaagatatatatatattgctacactcgctttgtttctggcagcatgttcggacaacgagctggaacagacttctgctccggaacaaaatacggaaatatatataccggctgatgctcagcccggagaactcattatcaaattcaaaccggagatggaagagattcttgaccagaccatgagtcgtgcgtcaagaagcggagcggcgatgacccgctccggcatcccctctaccgatgaagtgctcgacatactgggcggataccatttcgaacgtgtattcccggtagacagcaagaacgaggctcgtacccgtgcggcaggactgcacctgtggtatctggtgaaattcgacgagaacatcgacctgcacgaggctgcacgccagttgtcgaaactgggcgacatcagccacgttcagtgcaaccaccgcatcaagaaggcatacaactcggatgagaagcgggtatatgtcagcgaaaacgcactgaaccagactcggtctaccttcgctgcgatgcagaacactcccaacgacccaggcttccccttccagtggaactacaacaataccggtgactatgccttcgaaaaccagaatgtggacatcaacccgctgtatacggcagaagctactccgggatgcgacgtgaactgcctgaatgcatgggagaaatgtacaggcgatccttccatcatcgtggctgtgctcgatgaaggtgtgatgtatacacatcccgacctgaaagacaatatctggataaacgaaagtgaaacgttgggcagcaagaaagatgccgacggaaacggctacaagggcgacaagtacggctacaacttcgtaaccgattctggtgatatcacctggaacgacgtaaacgataccggacacggtacgcacgttgccggaatcattgcagccgtaaacaacaacggacagggtgtctgcggtatcgcaggtggttcgggcaagcaggatggtgtgaaaatcatgtcactgcaggtatttgccggaaactcgggcgtaacactcgacatggaggctaaagccatcaagtatgcggccgacaacggtgctgtcatcatccagtgcagctggggttacaactcaggtctggcaaacccgatggacggatatactccgggcccggcaaccgaaaaggaatgggaagaagcctatccgctggaaaaggaagcactcgactactttatcaacaatgccggttcgcctaacggtgtaatcgacggaggtctggctatctttgctgccggcaacgagtatgctgctgttccgggttatccgggtgcttactccaagtgtatcagcgtagcaggtacggctgccgacttcactccggcatcttataccaactacggtccggaagtagctatcagtgctccgggcggcgacctagaatattacggtagaatcggcgaaagcgatgaagaatatttcgactcttctttcacgcttgccgatgcgcagggttctatcctgtctaccctcatccgcaacggacagcctgcctacggatacatggacggtacttccatggcttgtccgcacgtatcgggcgtagcggctctgggactgtcgtatgccgtaaaactgagaaagcacttcaaggcgcatgagtacatcgaactgctgaaggaatcatcgcaggaaatgtacaccggctacacaggcaacaagatttaccacatgaatcacaacattgccggaacagccatcaccaagatgtctttgccttcatacaaggacaagatgggtgccggactggtaaatgcaggcaacttgttgaacgaaatcgaaggaaacggctcggaaatgatcgtaccgaacgtatacgtaggtcttgagaaggctgaggcaatcgacctggcacgctatttcgtaaacggtgaatcgctgacttacacttgcaccatggccgacacttccatcgctacggcaagcgtaaacggtacggttctgactgtaaccggtgtcaaggcaggtatcaccaagctgacagtaagcacaagcaacggaaaatcgcagactgtaacggttaccgttcgcaagggagcaaacgataacggttggatgtaattataaggtaattcattaatgaaactattcgaatcgatcagattaacgatactgagtgcactgatgtgctgccccgggctgctgatggcccagggcgcgcatccgcttacccgtcaggagatagactcgctgctcaatccctcgctgctgaagggagcggataagctgctggagtttgaacggacggtaatcaatcttggcgaaatgacggaagacgatgcgcccgttacggtgaagtttgctttccggaatgccggtacacagccagtagtcattaccaagatacataccgactgcggatgtaccgctgcccagacagacaagttgcagatacagccgggagaaaaaggttccatcaacgtaacctatacgcccaagaaccacccgggaaccatcgatgccaacacgtttgtatactcttctctctcagacaagcagccgctggcaaaactggtgctgctgggcaatgtacagccgggcggtgacaaatggagccgctatccgtacgccatgggcaaactgagactgaaacagaacaaggtgacattccggatcgccgccggaggaaacggcagacagacggaaagaatcctgtgcggcaacagcggcacgacagacctgaagctatccgtcatgaacctgccccgctatgcgacattcaagacggaacccgaagtcatcaagccgggacaggaagccgacatcgtgataagtatcgacgcttcgaagatgaccggaaagaccagaagtttcaaggctcccctgattctcgacggagtgacaggacggccaagcgaccgtaccctcaccctggaagttaatttaatcgataagtaaatagtaaaaaacaacagatagcatgatgaaaaagaaaatagtaaacatattgatgttgctggtcatttcgctgatgactttctcttgtagcaaagacgaagtggtgaccgaacagccgctcgaagtgaatcctatcacgatgcagggaacatggaaactggcagaactgaacggcgaacagttgccggaagatttctatatctacgtggtgttcgaccgcaaaggaaactttgaaatgtaccagaagcacgacagcatgtatccgcgctacatcaccggtacttattctatcgaaaaggatgcccactacggatacatcctcagcggagaatacgactacgagaacggcgactggaacaacaaatatgtcgtaaccgatctgctggaatccggttcaatgatatggaccgtaaaagacggcgatgaggtttcgaaatatgtacgcgtagacgaggtacctgaggaaataatcaaggctgccaaggtagacgagggcgaagaataatagctctctaatctcctgataacggataccaatatatcccccgaaagtcttttgaaaagggactttcgggggattttttattctgcaaaacgagcctgctcgcgtgcatacccaatcacgaacgattgtcaggtggcacgaacataaacggtattatgagaaaacttctttgtataaacagagaatatgaaggccccaaagctgttagaacgcaacaatacgaaagccaacggtattgaagtcacaacctcatagataccaaacaggactaactccctgatgaggcaatataaaaaacaaagggactatataaacactccattttatgtccagtttgaaatcagaagggggcgtaaagacaaagaaaagagtcgtatcatcgctctcaaacagagcttgatacgactcttctccatgtctttatagtgatatctgtaacttgttatctatacaaataacgcttattccattttcagtttcagagaacgatcgtccggtcctttcggatggataacctcttccagacgtacatcgaacaccagcgctgagtatgcgggaatctcaccactagctaccgaaccatatcctaatgaagctggaatatacaactcaacgtgctgtccttccttcatttgcatcaaggcagtagtccaacctacaatcacactcacacccgaaacggcaaaacttctcggttcactgacttcagcattccagttaccagagaaactttgatcgaataccgtaccattgatcagttttccacgataatgcacagccacggtatcggtacccaaaggagaaatgcccagcggttcgatatcatcttgcgggaaaagcttcatatacacatagtcattctttcccggcgtataagtctgataccccaatccctctgaagcctctgtctgtatcttatagttaaggatcctcaaccagttttctccagcgggaggattcgcacagatagaagctatggagtcgatatacgcatcattgcgcaccgcccagtcactatacggatcagctacctgcgtatccttactacaggaagtaatccctatgctcagcgagaagaagatacccaacaaatataagatgttcttattcatgtacatgctatattagattattctaatgttttcagcaaactagtaatgctaaccttgtcggcaatgatattattcaagtcggcaatagccacacgttcctgttccatggtatcacggttacgcagtgttacgcagttgtcttccagcgtctgatggtcgatagtgatacagtacggagtaccgatggcatcctgacgacggtaacgtttaccgatactgtctttttcgtcgtactggcagtggaaatggaacttcaggtcgttcatgatttcacgagccttttcaggcagcccgtctttctttaccagcggcatgatagccagtttcaccggagccagtgctgcaggcaatttcagtacaacacgactttcgccattttccaatttttcttcgcagtaagaagcacacatcacgctcaggaacatacggtctacaccgatagatgtttcgataacgtacggagtatacgattcgttgatttccggatcgaaatacttgatgctcttgccagagaatttctcgtgctggctcaagtcgaagtttgtacggctgtggataccttccacttccttgaatccgaatggcatcaggaactcgatgtcggtagcggcgttggcgtagtgagccagtttttcgtgatcgtggaaacgatagtgatcgtcgccgaagcccagtgccttgtgccatttcagacgagtttctttccatttcttgaaccattcgagttcggtacccggttttacgaagaactgcatttccatctgttcgaactcacgcatacggaagatgaactgacgggcaacgatttcgttacggaaagccttaccgatctgtgcgataccgaaaggaatcttcatacgaccggtcttctgtacgttcaggtagttaacgaaaataccctgagctgtttccggacggaggtataccttcatggaaccttcggcagtagaacccatttcggtagagaacatcagattgaactgacggacttcggtccagttcttggtacccgaaatcggacaaacgatttcctcgtcgaggataatctgacgcagttcgttcaagtccggtccggcattcatagcctttgtatagcgttcgtgcaatgcgtcgcgtttagcctgatgttccagtacacgcaggtttgtgctgcggaactgagcctcatcaaaagcatcgccgaatttcttggcagccttggctacttccttgttgattttctcgtcgtatttggcaatctgatcttcaatcagcacatcggcacggtaacgtttcttcgagtcgcggttatcaatcaacggatcattgaacgcatcaacatgtcccgaagccttccagatggtaggatgcatgaagatagccgagtcaagtcccacgatattttcatggagcaacaccatgctctgccaccagtactgtttgatattgtttttcagttccacacccatctgaccgtaatcgtatacagctcccagtccatcgtaaatttcacttgagggaaatacgaaaccatactctttacagtgtgaaacaatttttttgaaaacgtcttcttgtgccatttttctttcttattttgatatttcttattttacattctcttacatagtagggcacaaagatagatatttataagcaaaaaagaagaatcgctgtattaatttatcttatgaataggtggaatctgtaaggaaagatggttatttttttctacttttgcatcagattgaacgaaaagcaatgaacacgaaagacaaatttacgttaatgactaccgctccgatacccagacttatcggatcactcgccatacctaccatcatcagcatgctggtaacttcgttttacgttatggcagatacttacttcgtaggaaaaatcaatacgcagtctactgccgcggtcggcatttcgttctccatcatggccatcatacaggcattcgggttcttctttggccacggctcaggcaactacatctcgcgcaagctgggtgcccaggactacgagaatgcagaaaagatggcctcaaccggattcttctacgccttcatggcaggcgcgctgatagccctcttcgggcatctgttccttacggaaatctgtatcgccctggggtctacccccactatcctgccctatgcggagaaatacctgggcatcgttctgctgggagctccgttcatggcctcctcgctcgtactgaacaaccagatgcgttttcagggaaacgcggtgtatgccatggtaggcatcatcatcggggcggtgctgaacatcgggctcgacccgttgctcatctttgtgttcgacatgggcatatcgggagccgcgtgggccacattgaccagccagatatgcagtttcacggtactgctcatcatggacagccggggtacgaacatccgcatccgtttcaagaattttactccgaaggcttccttcctaaaggaaatcgtcttcggcggaagtccctcgctctgccgtcagggactggccagcctgtcgaccatcctgctgaacgtagcagccggagtctacggcgacgcagccattgcgggtatgtctatcgtaacccgtatctgcatgttcatcaactccttcctcatcggtttcggacaaggattccagccggtatgcggcttcaactacggtgccggactgttccaccgtgtgcgtgagggattctggttctgcgtaaagacgggagctgtctttttgttcgtctgtgccgtcatcggttacatcttctcgcccgaaatcgtatcgtggttccgcgacgacccgcacgtcatcgaaaccggaacacgtgccctgcgctggcagctcattaccctgccgctgggagcctgggtcatcttgtgcaacatgatgcttcagaccatccgcaagccggtacgcgccgttaccctgtcgtcggcacgacaagggctgttcttcatcccgttcattctgattctcccccatttcttaggattgcagggtgtggagatgtgtcaggcagtgtccgacctctgttcgttcctgcttgccattccgctgacagttcccgtgctgaatgaaatgaaaaaataagcctttttccggaaaaagatgccggagaagaaacggaaatttgtacaaaagaaaatcacgtttgtacaaaacaaaaaaggatttgtacaaattccggggaaagcgtgcccgaacgatcactaaatgatgccggaaaaatctccttagaccgtcctttaccgggaagcgtttccccaataatttctacaaaaagcggacggacaggcaagaaaaaccggcttatccataggttcaatcccgcttttcggacactcggatgcgggtttattttcaataatatagtaaataggaacattttttttcgtatttttgtctgttgtttttccactaaatcacttatatgagcgaagatactttcgaaaaagacgatatccaatcaagcgataaagaagcacattctgactataagcccgtcgatcaggacaacgaggccgtgaagcatcagttgagcggcatgtaccagaactggtttctggactatgcctcgtatgtgatactggaacgtgcggttcctcacatcaacgatggactgaaacccgtacagcgacgcatcctgcactccatgaagcggctggacgacggacggtacaacaaggttgcaaacattgtaggacataccatgcagttccacccgcacggcgatgcctccatcggcgacgcactggtgcagctgggacagaaggacctgctcatcgactgccagggtaactggggtaatatccttaccggcgacgatgccgcggctccccgatacatcgaggcacgtctttccaagtttgccctcgacgtggtgttcaacccgaaaacgaccgaatggcaggcttcttacgacggacgaaaccgtgaaccggtgacgctgcccgtcaagttcccgctcctgctggctcagggtgtggaaggtatcgccgtaggtctttcatccaagatattgccgcacaacttcaacgaactgtgcgacgctgctatcgcctacctgcacggggaggagtttcacctctatcccgattttcagacgggaggctccatcgacgtgtcgcgctacaacgacggcgaacgcggcggtgtggtacgtgtgcgtgccaagatttcgaagatagacaacaagacactgtgcatcagcgaaattccgtacggaaaaacaacatcttcgctgatagaatctattctgaaagctatcgagaagggcaaaatcaaggtgcggaaggtggacgacaataccgccgacaaagtggagattctggtacatctggccccgggcgtttcgtcagacaagacgctggatgcgctgtatgcctttaccgactgcgaggtgaacatctcgcccaactgctgtgtcatcgacaacaagaaaccgcatttcctttcggtcagtgcggtgctccgcaagtcggtcgacaatacgctgtcgctactgcgtcaggagctgaacatccagcgcaacgaaacactggaaacgctgcacttcgcctcgctggagaagattttcatcgaggaacgtatctacaaggacaagcagtttgagcaggcggagaacatggatgctgcctgtgagcacatcgacgagcgactgactcctttctacccgcagtttgtacgtgaagtgaccaaggaggatattctcaagctcatggagatcaagatggcgcgcatcctgaagtttaacaaggacaaggcggacgagttcatcgccaagctgaaagcagacatagaagagatagacaaccatctggcacacatcaccgaatataccatcgactggtacatgcggctcaaggagaagtacggcaagaatttcccgcgacgtacggagatacgcaacttcgataccattgtggcaaccaaggtggcggaagccaacgaaaaactgtatatcaaccgcgaggaaggattcatcggtacgggactgaagaaggacgaatatatctgcaactgttctgacatcgacgatgtgattatcttctacaaggatggaaaatataagattgtgcgtgtgtccgacaagctgtttgtgggcaagaacatcctctacgtgaacatcttcaagaagaacgacaagcgtaccatctacaacgtgatttaccgcgacggaaaagagggattccactacatcaagcgtttcaacgtgacttcgatgatccgcgaccgtgaatacgacgtgacgcagggtactcccggctcgaaaatcgtgtatttcactgccaacccgaacggagaagcagaggtcatcaaggtgacgctccgtccgaatccgcgcatcaaaaaactgatattcgagaaagatttcagtaccatcaacatcaagggacgccagtcgatgggtaacctgctgaccaagtacgaggtacacaaaatcagcctgaaacagcgcggcggctctacactgggtggcagaaaggtatggttcgaccacgatgtgctgcgtctgaactacgacggacgcggacagtatctgggtgaattccagagcggagaaagcattctggtggtacacaagaacggagaattctatacgaccgacttcgacctgaacaaccattacgatgccgacatccagttcatcgagaaattcaatgccgacaaggtatggacggcggtactctacgatgccgaccagcagaactatccgtacctgaaacggtttaccttcgaacagacttcgaaacgacagaattatctgggcgaaaacaagcataatcagcttgtcctgctgtcgagcgaggcttatccgcgtctgcaagttgtattcggcggtcacgacagcttcagggaagcactgattgtggaagccagcgactttgtgggtgtgaagagcttcaaggccaaaggcaagcgtctgacaacctttaccgtagaccacatagaggaactggaacctacccgaaagccggaaccgcaggaggaaaccgtcgaaacgaatgctccggaaacggaaaacgatacgacggacgaagacaacgaacaaatgactttattctaaaaccggaaccatgaaacagaagtttatcatgctgctcatcgccctggggactttcttgtctgtcggcgcacaggaagacagtctgcgtgccacacggtacgtcatgcggtctaccctgttcggcgtaggacacagtaacgtattcgaaacgtatctttctccgctggaatatacgggaaccgaggtacgcttcctgcacgaaagcatgcgcatgacacgcctgctgggaggcaaggtttccggacagagcctgattcaggtgaatgcttcgtataacaagaatatctctcagacggccgagatgtatgccgggctggtgaactggagctatgccctgcactatcagttccgcatgaacgacgacaagctgaaaatccttgtcggaccgatgctcgacctgaacggaggggtggtttacaaccggcgaaactccaacaatcccgctcaggcaaaggcctacggcggactgggagcatcgggtatgcttatttataagttccgcattgcacgctatccgcttacggtacgctatcaggccaatctcccgctgctgggcgtcatgttctcacccgaatacggtgaatcgtactacgagattttttctttaggcaacggcggacggaacgtggtgttcacttcgctgcacaacaacccatcgctgcgacagatggtgactctggacttcccaatacgcaacgtaacgatgcgcgtgggctatgtatgcgacatccagcagtcgaaggtaaacaacctgaaaagccacgcctactcgcacgacttcatgataggcttcgtacgcaacctgtatctgctccgcggaaagaaccgcatcagcatgccacttaaagtaactcccttttagcttatgaaacgacttgcacgcatattatatacggtgctgaccggactgctggttttctcttcctgcatacgggaggacatctccggcaatacgcccgaagataatttcgaggcactgtggaaaatcatcgacgaacagtattgtttcctcgactataaaaatcaggaatacggactcgactggaacgaggtgcacgagcgctatgcacgccgcatcacgccggacatgacgtgggagaatctcttcgaggtcctttcggatatggtcaacgaactgcacgacggacatgtgaatctttccagttcgctggctacctcgcagtaccgcgaatggttcgacagttacccgcgcaacttcagcgacagcatccagagcatttatttgggaaaggattataccaactcttcaggactgacatacagcattctggagaacaacatcggctacatctactgctccagcttctccaacgggataggcgacggcaatctggaccagaccctgaacaagctagctatctgcgacggcctgattatcgacgtgcgcaacaacggcggcggcaacctgaccacggcacagaagctagcggcacggtttaccaatgagaaagtcctcgtgggctacatgtgtcacaagactggtcccggacacaatgacttttcggacccgaaaccagtgtatgtggaaccctcgaacggtatacgctggcagaaaaaggttgtggttctcaccaaccgtcgttcgtacagcgcgacaaacgactttgtgaacagcatgaaccagtttccgaatgtcacaatcgtaggcgacaagacgggaggcggttcgggacttccattcagttccgaaattcccaacggctggtctatccgtttctccgccagtccgatgttcgacccaaacatgaaccagctggaattcggcatcgaccctgatgtgaaggtggacatgaaaagcgaggatatgcagcgaggaaaggataccattatcgaaacagcttgcgaaatcctaaagaaataggtctgatattttgctttttcaaaaaaatagtatatctttgcacacgcaaaaagggaacattccgtatgttctgcttgcgcctgtggcgtaattggtagccgcgccagacttaggatctggtgccgcgaggcgtgtaggttcgagtcctatcaggcgcacatctttcaagacattaacgataaaacccggcttaaacggtaagtttagccggtttttttattgtcctaaaggcactttgtataattatccacaaaaacaaggtgccatattcggtgacatgaacgtcaatctgaagtttacccatttccaaatacaaaagaaatagaagtacatccaatcgtttcaactcctctaaaaaacgacaaacagcaaccagcagacataatatgagctgcaccaaactttattaagtcatggcacagctcatttgcttgcagttaaaacaatcaagtttccaattcaaaactcattctttcctgaatgtgaggtttgacagagttccctttcaattcttttcgttatcgtccatcatgtttcagaaagagcattgtaatactgactctttcttttgacaaacgctaaactacctgaaacttacttcagctgaaaagccaccttcgatttgatatcggtagccgaagcagctacaagagcttcgaatttaccgggctcggcaacccacgcatgctgcttatcgtcgaaataactcaggctggacttatcgatggtaaacgtaaccaacttcgtttcacccggagccagctgaatcttacggaaacctttcagttcttttaccggacgagctacagaacttttgacatcgcgtacatacagctgaacgacttcagcacctgccacagaacctgtatttgttaccggaacggttacatggatactatccgacgcggacagttcgttacgatctaaagtagccttaccatacgagaaactggtatagctcagtccatgtccaaacgggaacagcggctggagcttttccttgtcgctccaacggtaaccgacgaaaataccttccttgtaagtgatatcccaaatattctcagaagcacgtttcacaccgggataagcatccagacgatgactgcctacattctccagagaagtggggaaagtaaacggcagacggcccgacggatttacatcgcctacgataacggctgccagtgcattgcctgcttcgctgccaaggaaccatccctgaatgatacccggaacctcatcaacccacggcatggctaccgcatttcctgaaatattgaccacaaccaagttcttattggccttcgcaagggcttcaatcaccttatcctgtccgtaaggcagacctaaagcctgacggtcggaatcctcacaatcctgacccgcactcttattcaagcctccaaagaagatgacataatcgcaagaacgagctacatcgacagcttctgccagcagttcctcggcagaacgattgtcggaaagatcctgacctgttacgactccattgtattcaccactggcatctcctacataaccacgggcatataccacttcggcctgaccggcaagacgatgacggagtccgtcgagaggagaaatttcgtattttactttcagtgaagaacttccacctcctacagtcatcatcttgatggcattctcaccaatcacagctaccttcttcaccttgttcaagtcgagcggaagcacattgttacggttctggagcagtacgataccctcttccgcaatgtggcgggaagcatcaaaatgttccggactaccgatagaaccgaacggacgattacggtccattgtcgtacggaaaataagacgaagtacccggcgaaccttgtcatccagttcggcagtacctaccttacccgatttgatacgctgaagataaggatatgcaagataataattgtcgtaagcattgctggtaccactggaaagtccgttcgtccaactgccgaactccagatcaagtccgttggagattgcctcatcggtatcatgagctccaccccagtcgctcaccacgacaccgtcgaatccccattcgcctttcaggatatcgttcaacaaatattcattgtgacagcaatgctggttcttgtacaaattataagatcccatgatgctccaggcatgtccttcctgaacagccgccttaaaggcaggaagataaatctcgtaaagcgcacggtcgtcgactataacattcgatgtatgacgatttatttcgttgttgttcaatgcaaaatgttttacgcaagcagctactccattgctctggaccccacgtacataaggtaccaccatcttactcgacagataaggatcttcgcccatatactcgaagttacgtccgttcagcggcgtacgatagatgttcacacccggtcccagcaagatagacttattacgatagcgggcctcttcaccgatgcttttgccataaagcagcgccatatccggattccacgttgctgccagacaagtcaaggcagggaaagccacacaagagtcgttggtccatcctgcctgatcccattcatcccacagcacttcgggccggataccgtgagggccgtccgtacaccagacttccggaatacccaaacggggtactcccggactgctgaacttagactgagcatgaatcatagctattttttcttgcagagtcatacgtgagagagcatcctccacacgtgattctataggttgattaccatcaagataaacgggcagctgctgtgcttgcacagagaataaagcaagtccggcaacacatgccagcgccatttttttcataaattcgtttttcataatattttcagttataaattttcaactatactaacgcgatgacttcagttcaccataccatttattcaaagcctcatctgccagtaaacgcatatcttgcgcctcctttacagataagccatcgggtacataagttatcacagaaggactttcttcaaatataacagcatactccatacacgcagccagataagaggctttaagtgaaggatgccgattgtcggtatataaagcagcacatcccttttctccctgtgtttcaaataaaatcttatatgccattcctacaggacacaccacaacaccagggatttcccgacaaacattcaaatagctgcgtaccagttcctccgaagattccttaaaccgggaccagtcgctgctatatgcccagttcatgggaaggactataacaggctgtttttccggatatgcattgagtaaagccagcttccataacttaacactctccatcaagatttcaggacataacctgggtaatgcactctgctcctgcaaaataatataattccagtgactagacaatgcaagttgccgagaaatttcatcattataatgatacagcaaggtacgtcctaactgggtccgtgcatgccatcgcgcctccttccccatacttttgaccatttcattaaatatctccggctgattgttgtagtcgatcagactgttattcaacgaaaagatacttacaggctgagcctgcatgaccttcagaccagaaggtaaaagcaggaaaatcaagcaaataatccgaagtatacctttaattttcatggcaggtcaatcctattgaagttatataatctttttgcggaacacaattctcaaatctgcaactctttataaaatcattcattgcctttctcaccatgtcctgatccggacgtgcctctcttatatgctgataggtatcacgcaacgtttcagaaaaggcaattatcttgtcccagttctcaggcatcttaatacccatcatacacgagtcgtcttttttcttataaggccaaaacgtatagccaatattgttgtcggtcatgaccttacagaaagcggcttgccactcgtccgtgttgtgaccaatttcccccatatacataggcaggttcacgctatcgcgaaaatgaataaaatcctgaatagcttcttttgtaggttcacctccataacggtgacaagtatacatcagtttatcatcatatctggcatcgctgaacggtttgaaattactattccattgtgctcctcccagcaagattatatgattgttgtctacctcacgtatagcctttaccgcccgtttatgcaatgcttcgagcttgctgttcagttcatccctgttgtcaaaataatgagctataggctcatttattaactcataccccaatatgaccggttcattctgataacgtccggctatcttcttccatatatcacagaacaactgctggctccgttcactctcaaacagccacgggtaaccataactatcgtctatattatcgcctgtttgtcctccgggggcatcgtgcatgtccagaatgagatatagcttattgtcacgacaccagtttacgacactatctatacgggcgaaaccatcctgacagacagaaagccccatataatcctcatcggtaaacaatttataatgaaacggaagccggatggtatttgcaccggaagaggcaataaactcaatatcctgacgggtaatataattgtctttaaactgtttccagaaatcagccgtaaaatccggaccaaccagctgacaaaacatatcgtttatcattctggctgaattagtttttgtaaagccaaacatatagccttcgggattcagccagttgcccagatttgtacctttaatatgtaaggtatctccatcgggctgaatcagattttcaccttcaatgcgtataaatgaagaagtgaaagctttctcttcctcagattgctgtgtgcacgatgtgagaagagaaaggaagaaaaaaggcaaaacaaatgtttcatataagtattaaatattagtatgtgtgtttttagtaataggataattaaaactgtcgataagattatataattccagaatttatcagacaagaattctttattttttttggaagacacgcacataatctactttcatcgtgacaggcaatgcagattcgtccacgcctttataaccaccccaatcaccaccccaagcgaggttgagaataggatagaaggcataagtgaaaggccatacctcccgacccgtcccctcattgttaaaggtcatcaacacctcaccgtctacaaagaaacgaatatagtcttctgtccattcacaggcatatacatgatattctgattctgcagtaccgatattacggtttgctgttttctgagtgttcatcggatgattgtaagccgcacaatgaatagaagaactgacaatgttagcatccgcccctacttcctccataatatccatttcaccacattgaggccagggattagtgccgtagtcgttgtttacaggcatcatccaaaaagcgggccatgtacccttccccttgggcagcatgatacgcgattcgaaatacccgtacagccaacccgtattcaggtgcgcatagacgcgaccagaatagactttaccgtcactacctttaaagcagtggatattcagtttaccatccaccagttcagtaactcgtttgccatcggcttgtccattaacataggtctgcaactcattattcacccatcccggtccctgtacctcatgagtccactcactgcttagagttgtaccttcatcaaattcatcgtgccaaactagtcggtagccttcgggggtaataatatcacggtcttcggcagactcttgataaacgctgactgtagcttcttcagctccagccttaatgcagattgtacctcttctactcttctgtgcatcattgggtaaggttctaacagtcaatgtattctcatcagccttatccaccgtcatccagctatctgatggctgtgcattccagcttccacttgctgtgacagcaatggtaaatgtttctccactggaatttgaaaatatttcctgtacagagagttgcataggggctttctgagctatttcaacagttactcgagtctgtcctgattttacaataacagaaccattacgcacacttgcagtattattggcttttaccgtaataagtacctgaccgttatcggtagaaggattaatgattttagtcgagacccaactactacagttatcgttagcaaaagcagtccattccccgctactgcaatttacaataagaggatattcatctccgacagcttctgcctcgatggatgttgggttacactccaaagttacatttccacctgtcagtgacaaatcattatcactgtcgccacaggcagtaagtaccaaaaagagtatcggtaaaatgtgatatattatgttcatggtaaaaatgaaaattgaatattagattcaggctatctgattaaaatatctttgctatcactaaaaaagagggaatgccataaatattacgcagaaagtactctgcagatactattgacataccctcttttatgaggaattatttatttcctgataagcgtaatttcatcaataacaacaacagttccttcctcggcaccactaaagtcaaataccaatttaagttttgcagcatcagtaccacctgccaacttagcattgtcaaagcggaaaacatagccatctactggaacttcactgcgagattcaaaaaagtagttctcatcatttccgttttcagtcaactttactgtcatgcctggtaatttcacagcatcaccattcagagtagcatgtactttcaaagaaaagtcaaccaagtcatcagcactcgcagaaagttctgtttccatattatactgtgcgtgccaagcttcgttaggagttgtagcaggaatagttatcgtatgtcggctaccttcatgggtagtttctaccgtacatggaatttcactccaattggcatctccaaaccagtgactttctgtaaatgccttagcatcgtcaacagccttccagatattattgggatcgttatagttgaatggagtggctgcctgttcagggatttctgtaccatcatcatttgcatgatctttcagtacaaagccctcaaatgtaatagaagtgttatctgcattgcctccaaagtcgaacacaatcttcaggtcactgatatcttttccttccagctcggaagcccacaaagctttcggctcattagcctcaagagtaaagtccttatccattaatactatgttatcactctcgtcgcataattttactttcacaccaccgtgagcaactgtagaagtcataatgacagagaagtcatatgtttttcctgccgaaacagcaatacctgtagggaagaacaacatctgagcctgccaacgttctgaagttgcatttggaagagtaacagaataagtaccatccgatagattccatgttggattaggctgctgtgtccatcccggagcataatagaaacccggctcaggcaatgttactccattaaacagattgaattcactatccggtacgaaaccagggaatccattcatttgagtattctctatctcaaattctttcacgatggatccatcactgataccattggcattttttaccttacactctacagtataaataccttttttacggtaatatttcgacatcgtgtatgaagcggaatacgaaccgtcaattatccatacaggtgtaatacccggagccgatttaaactcaaaataagcatagttggtttcctggtcaactgttatgacaacattctcagcatagtcggatgccaatggaatatcgccattggctccaacataatcttctggtgaacaggcagtcagcgaaacgacagtcagaaacatcccagaaatatatttaaatagatttttcactactgtccaataaaagttggttaatgggcctttgaaattgttgaaatacagtcttttaagcagtattttagaatgaaacggatttgaattcgtagcttagcggtcaaattgaatgccgcttatgaaccaagataaatacgtattcgctcaacttaccgcttttatgaacagaacacaattcaataactttgttcgcaagtataatggtaatcgctacgtgaaacaattcacctgctggaatcagttacttgctatgatgttcggacaactgagcaatcgtgagagtcttcgcgacttaattgtagcttttgaagcgcatcaagccaagcaatatcatcttggtctgggacgcaatccaatagccaaagccaccctcgcttatgctaatcagaatcgtgactacagaatctttgaagacttcgcattctatataatgacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtaatgaaggaagcttgtgaaaagcgagcgaccaacatcttggatattccagggaataagtatgcttttgattcaacaactattccgttatgtctagccacatttccatgggcgaagttccgaagaaagaaaggaggtgtcaaagctcatgtcttatatgacattgaagcacaagttcctgccttctatactgtaaccacagcatcgaagcacgactctacagcgatgtgttcaatccattatgaaccaaatgcttattatatattcgacagggcttatgactcttttaaggaactatataggatacacctgacaggttcctttttcgttgtcagagctaagacgaacttgaaatacacaatggttaaatggaagcgtaggatgcctaagtatgtacttacagatgctgaagtgaaactgaccggatacctctcagagaagaaatatcccgagtcattccgactcattcgttactatgatgaagagggtgaccgtgagttcactttcctgacaaacgcaacacatatttctgcattggacgttgctaatctctacaagaaaagatggttggtcgagctattcttcaaatggctcaagcagcaccttaaaataaaaagattctggggcacaacggaaaatgctgtccgcattcaaatcagtgtagcaatcatcacttactgtctagtggctattgtccaacacgatatgcaattgaagcgctcaacttatgaagttttgcagattctaagcatctctctaacggacaaaactaacttgcgtgaactgttcgataagactgatttcaacgatgtcaaagaactcgattatcccctttttgaaggactatttgattaattttttaactagtccatttttattggacactaatgatctgaaatatattatttattctgccatggcagatatacgtacggcaaacaaagatatagcttcgttggaggagcttatacaggacttatttaccataggtgacattgatcgtgcttatacctatggaaactattgcctgcaaatgggacaggcgtatcataatcgcattcgtgtagcggatattttatctatacttgatgagatccataaagcatatcagaagcgtaatcaggaacaacagggccgtctttcccgttatctgataatgatgagcattctttccgttatattgttggtagctgttttgtacatatacaggcaaatgaggcgtttgtccgagtccagacaaaagttgaatgacgcgaataattcgttaaataaacatattgtccagttatccgagacgcatcataagatggaagaaatgaataagcagttgcaattattgaataaagaacaggctgtcatgaatgaccaacttcgtgagtcgaattatattgcagaagaatatatcgcttatgcattttctctttgttctacttatataagtaagcttgacgagtttcgtaaaacgattaatcgtaaaataaaaacagggcaatcggaagaagtcaagcaaattacggaagcatctgtcgtgaaaaaggagttgaaggaattctatcatagtttcgatagtgtatttctccggatatatcctgactttgtgcatgattttaataatctcttgcgtccggaagaacagattgtgatgaaggaaggagagttgttgaatacagatctccgaatttatgctttggtgcgtttggggatcaatgatagtgtgaaaatagccaaatttcttcattgttctccccaaactgtctataacaatcgtttaaagatgcgtagcagggcatgtgtccctaaagatgaatttgtggagcgtgtgaaatcgttgggtaaggtacaggataaaccggcctaagttatactaataaaatttcaataagagtattgggtaaaaatttgcagatataagttatgttctgtctgacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattggtctgaaataagtggattgcttaatttaacttgaatttaatataaaaataaatataatctggaacatagtaatggatttatagtgtcaagttatagagatttttggtatgactgatgatttttgcaaggaatttgttctaaaagaagaaaaatatataattgaagactagagaaaagattcttcaaaaatcctaactaactacatgagcgattcttggattatcatggttgatcttatcttatttcattctagcggttttattacttcaagtattattacaagaagtatgtcagcaaacattgataaactatgtgtgggcaaggaatatatgggaaatcctctgttcgagaaccttttttaactctatatagcttttgtcactaagatcaagaatgatatgaggaatttcctaatgaatattgctgacaatatttcgttgagaaaaaggattttgattcggtcaatggtgaattgaagaacattttcctgattgaacattctataaattgttttttaacaacttcattgcaaattcggtttcttccattatggtatactgtctctttttccttgggaaggaatttgtcattgaggtgaactttatcaatggtagacaatttactacttcctaattttattttaaactagtaagataatgcttgagtaagaattgggattgaaaacaatgatactagggacattgtcggttgtagatttgggagtaaggttgttggttcaaaaagttttagagcaatgatgatatgtgaaagatgtaagaattattgctcctgaaaatatgaatccggcttcaatgggtttctaaaaaatagttgaaaagtttacttttaagacctcttgctttttgtgtaatttgttggttataaataaactatgtgttttttagatttactccttatctttaccggttcgtacaataaaagaagttaaattttatttttgcatcaacagaaagcaaaagtaaagttaacttaatttatttctaattatgaaaaaacacttcaaacacccccagttgtcaaggaaatatttcctgactggatgtctgttgcttatcgtttcttttggagcttcagcccaacatgcaaaagacaattccacttctcctaatcaggagtatacccaacagggtattactgtaaaaggaacagtaaaggatcaaactggtgaaacaatcattggtgctaatgtattagtaaaaggaacgaccaatggcattattaccgactttgatggtcagttcgtattggagaatgttcccgaaggagctattattgaaatttcttttgtaggttaccttccacaggaagtaaaagcttcttctactcctttaaatattgttttaaaggaagatacacaaactctcgaagaggttgtagtagtaggttatggtgtacaaaagaaaagtgtagtaacagcatccattgcaaaagtatcctccgaagatctcgaaaacaaagcacctgtacgtatggataatgcattgaaaggtttggcttcaggtgtagatgttacttcagcatcggggcagccgggtgatgctccacgcgtgcgtattcgtggtattggtacaataaataatagtgatccgctttacattgtagacggtatgcctatcagtggtggattagattttgtaaatcctaatgatattgaatctatagaggttttaaaagatgccgcatctggtgccatctatggtgcacgtgcagcaaatggtgttattcttgttactacaaagaaaggtaaaataggtaaagctagtattaattataacttttcttacggttggcagagtgcttggaaacatcgtgatgtgactagtgcgaccgattatgctattttgcagaatgaaaaatatataaatggtggtcaggctcctatctatgcagatccatataatctgaccgacttaaacggaaatcctatcacgggctttggtactgactggcaagatcttgtattttatgataacgcaccagttgtcaatcatgacgtatccatcagcggcgcatcggagaaagtgaactactacctttcattaggttattatgctcaagatggtatcgtaggaggtaattacggacagtcaaactacgaccgtctgaccatccggtctaacacctcatatgtacttattgatgcaagtaaagaacgtaatttcctgaacaaattagatctgaacgtgaccatggcttacatgcgtacccattctacaggtgtatcgaccaactctgagttcggctctatattgggatcggctctttatctgtcacctattcttcctccaactttgactggtgaagcggcacaggcgatgatagaaaactatagtgatttcgacttaccgcatgatgagaatggtaatccatatacagtgcctggttttggagggtcatatgctgaaatgaataaccctttggccatgatgactttaccggcaacaaaaaactggtcgcataagttcgttcctaaatttgctatcaatctccagttatgggataatttgaaatatcaattcagttatagtgctgatatgggattttggggtaatgagggtgcaactacaagcaactattatctgtctggaaacaataatgcgagccatacaagtgccagtgcattcaaggcgcaaaatgttacatggcagattgaaaatacacttacttacgataagactatcgataaacatagctttggtatagtgttaggacagtctgcattgaaatataaaggcgatcagttgggaggtagccgttggaatttagttaatgtcaataagccgtctatcgattatgcgacaggtaatatccaatatactacggatgctaacggcaatactgttgctactccacagttcagtgtgtacggtggtccatatactgaacataccatggcttctatgtttgcccgattgaattacaactacgatgaacgctacatgcttcaggcaacagtccgtcgtgatggttccagtcgttttggaagtaacaataaatatggtattttcccttctttctctgcgggatggaacattgcaaacgagatgtttatggaagacacccgtaattggttatcaaactttaagcttcgtttcagttggggtaagaatggtaacgataatattggagacttcgcatatacctcaatgacatctatggggaataatgtgctatttggtaagaatgctataaaattcaatggttcgaaagctaatagacttcagaacccagatctgaaatgggaagaaagtgagcagactgatataggtattgaccttggattattaggaaacgcattgacattcagcgctgactattatatcaagaaaacaaacggtatgattcttgaaatgcctattccaagttatgttggtgaaagcaagcctttaggaaacgttggtgatatgcagaacagtggtattgagctggaattgggttacagatggagtatcgccgatgcaaatttctcagttaaaggtaatgcaacttacttgaaaaatgaattgaagaatctaggaaatgaaaccggatatatggatttggatggtatccagggttatagtggaggtggaacacgagcttctaatggacaacctttcccttactttttcggatataaaacggatggagtattccagaatatggatgaagtgagagcatatacagacaaaaaaggtaatatgattatgcctaatgccgttcccggagatacccgatttgttgatgtcaatggtgatgggaaaatcactcccgatgaccgtacaaatattggtaacggtacacctgactggacatttggtctgaatctgaatgcagactggagggggatcgatttcaatatcttcttccaaggagtagccggtgctgatgtgtttgacggtactttccgtaatgatgtggcttctggtaattatccgtcgtgggtattgggaagatggaccggtgaaggaacctcaaacaaatatcctcgtctggctgtgggaaatgacactaactggatggtatcagatttgtacatttgcgatggttcttacctgcgtttgaagaatattactttaggatatactctacctaaatttattactagaaaaatagctattgaacgtctgcgtgtttatgtgcaggctgagaacttgatgacttggacaaaatattggggatttgaccctgaaatttcttcaagcgcaacgtcattgggtgttgaccgtggtgtatatccgcaagcacgtatttttactatcggtgctaatatcactttctaattaatctataaaagaagaatttatgaagacaaataaaatatttactattggcttgatagctgctgcaactcttataacaggatgtagagatagctttctggaagtggaaaatccaagtggcgaaccattggaggaatattataccactgatgcccatattcaagaggcacttattgcggcctatgatccgatacactgggccgattggggcttagggcagtataatgcactgaatattgatgctgaagtaatgggtgacaacttttgggttggtggccagagtactaccgatatgcagaactggcatatgctgtttaatttcgaggctaatgaaaacaatactttcggttctctgtggactgtagactattctggtgtgaaacgttgcaacgatttgctgctatatctcaattgggcaacggatttaacggatgctaaccgacagagttacgagatgcaggctcgtttacttagagtcttctattataatatgctgtggcattactttggaaatatacctttttatctcgaaaatctttctgaaccaccctatacagctcctcaatatactgcagatcaggtttacaatgagctgattactgaacttgaggctgtgataaactctcacgttctgccgatgaaatattataaggatgccaacggtatggatgatgagggacaactaggacgtgttactcaagcaatggcttatatgatatatgccgagatggtaatgtatcagaacgatgaaagccggttcgctactgcacttaattatatgaaagagattattgcagatccgggatatgatttgaatcctagctatgccaatatttgggaaactgaaggagagtggtgtattgagtctatttgggagattaactacgagcaggctaactcagagcgtggatggagcagtcctctggcagtaggtggtactgtgttgcctactcttatttcacctaactctttcggaggagatgaaggctggtctcaaggtggtgatggctggggattccttcctgtacgagtagaaacttacgatatgtttgataaggctgacgtacgtcgtgaagctacttgttgggatttgcgccaatcagacgtaacttatactgcacgttatcaggatactcgtatttggttgaataaataccgtccttatgataagaattataagtcagctcctttcgaccaaaacttaaactataataataacctgcgctattaccgttatgccgaaactttacttaacgcagccgaactttcacttcgtacgggaggttctggtaccggtgatgcaaagacttggttaaatttagtacgtaatcgtgcaggtttggctggtctggacaaggtgaccattgatgatgtgctgacagaacgccatttggagtttgttggggaaggcaaacgatattttgacttagttcgtgcggaaggtattagtggtgtatcaagcaaaaacaaggcttctacagcacttgttcccgactcttacggatatcgtaccaattcatggactcctcagaaaaaatatatacctatcgctcagagcgaattagactctgatccggctttggttcaaaacaactattaataaccttataatgacaaaaacatatgaaaaatctacattagtgtccaataaaaatggactagttaaaaaattaatcaaatagtccttcaaaaaggggataatcgagttctttgacatcgttgaaatcagtcttatcgaacagttcacgcaagttagttttgtccgttagagagatgcttagaatctgcaaaacttcataagttgagcgcttcaattgcatatcgtgttggacaatagccactagacagtaagtgatgattgctacactgatttgaatgcggacagcattttccgttgtgccccagaatctttttattttaaggtgctgcttgagccatttgaagaatagctcgaccaaccatcttttcttgtagagattagcaacgtccaatgcagaaatatgtgttgcgtttgtcaggaaagtgaactcacggtcaccctcttcatcatagtaacgaatgagtcggaatgactcgggatatttcttctctgagaggtatccggtcagtttcacttcagcatctgtaagtacatacttaggcatcctacgcttccatttaaccattgtgtatttcaagttcgtcttagctctgacaacgaaaaaggaacctgtcaggtgtatcctatatagttccttaaaagagtcataagccctgtcgaatatataataagcatttggttcataatggattgaacacatcgctgtagagtcgtgcttcgatgctgtggttacagtatagaaggcaggaacttgtgcttcaatgtcatataagacatgagctttgacacctcctttctttcttcggaacttcgcccatggaaatgtggctagacataacggaatagttgttgaatcaaaagcatacttattccctggaatatccaagatgttggtcgctcgcttttcacaagcttccttcattatatagaatgcgaagtcttcaaagattctgtagtcacgattctgattagcataagcgagggtggctttggctattggattgcgtcccagaccaagatgatattgcttggcttgatgcgcttcaaaagctacaattaagtcgcgaagactctcacgattgctcagttgtccgaacatcatagcaagtaactgattccagcaggtgaattgtttcacgtagcgattaccattatacttgcgaacaaagttattgaattgtgttctgttcataaaagcggtaagttgagcgaatacgtatttatcttggttcataagcggcattcaatttgaccgctaagctacgaattcaaatccgtttcattctaaaatactgtttaaaagactgtatttcaacaatttcaaaggcccattaaccaacttttattggacagtagtgatttcagataagaagttttatcgccctcgtccaaatacaaatgagcaaggatatacgcattcagcgcatcacggtaagtatccaacccagatttgcttacagcatcaatcagttctttttgtatctctggtactttatcagctcctctactccttcctcctttataccaaagataaagcggatgctccggagtaatcaacatgcaaatggaatcacgataaagcatttctttgttgtaatattcccgttggcttttagcatcatctcctatatattgtccaaaatgagaatacagataaatcatttctccataatactcaatttttaagactgtcggcaaatcatttcccgatataccctgcaattcatctacagcctcttttaacagacctgttgccgtcaataaatgtgacttctttatcttccactctaatacacgctctttccaatccttatctgcagcaatttttaaattacgactaatataataagctgttgaatcggcatcataggcataatactcgtcatagaattttttattcaaccaatattcctcttccaaagaagaaacagtcgccttttgcaaccgaagttgagaaatcctcaattctttctctttttcaattatttcttttttgccgataagagaatccagttttaataaaagtttctctatttctttatttttcggtgctgcaattaacggtgctgcaataaaaaggaataaaagactgaagaggtttttcatacgcaactctttataattggttaaactgataacaaagatatgatctttatttttaataacattatataattataattaagtcacatttttaatatcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtaatataatgtgagttcgacataagaataaatataatcgattggaatatcgaaagtattaaatttataaggaccaattataactttttacgattatcactacattccccaaatccaaaattacagtgatttattgtatggctgatgatttttgcaaggaatttacactacagcagaaaaaatatacgactgaagacaagaaacagaaacatcgcattttagaaccagtatgcatagaacgacctattcccccgtattgtctatacggttccactttatattttcttggcaaaagcaaatcatccatcaaaaccgtatataattaagtgtgaaagcgattactatttcagatatgcattttcaaatctagaacaaaatacgttcccgttaactaatttagcctgaaaacagcaactctctttgatacccatatcgctgaaaaatacaggataccaaccatcccttctgtcgatatagatgttacctcatttatctgtgcatccatcagagtaaaacgctgttaaaacggcctcccaaatatcaggtaaaaaaagttatcaaccaatcttaatcttctgtctgctcctcgggccagttcacaagataaagtacttccgtagcacgggtaaaggcggtatacagccaacggtaataatcgggggtaagcatctcctccgtcatatagccctgatcgacaaatacacgctgccactggccgccctgtgccttatgacacgttacggcataggcgtatttcacctgaagtgcattataccacgtatcctcctttatttttttcatccgttcacgctttacggtaatgtcaccgtaatcttcctgcacagcctgaaacagcctgtcactttcctctcgtgtgagagcaggggaatccgagtgcaaggtatccagcagaatctttacatcgagttccaagtcgttgtaatcgggaaagcataaggtgacatcggcaaaacggaaaccatacatttcgtgcgtgcgacgcacccgacgtactacggcaatatctccattggcaatgaaatccatttccttgcagtccgccccccagtaataattgttcttggccaccatcagcaaatcgccggtattcagttcatcctccctatataatatggtgttacgtattcccttattatacagattggcacgcttgttcgagcggcagataatcattgtttcatccatgcctgccttgtcataacactcattgatggtatcaatcagctctcctccggagatgatccggatatcggggaaaccatccgccttgatccgcggcaacgaaaaatactcttcctcggctatatattgcctgagcgatgtcgcattatacaaaatgccggaatcctgttcctgacggacaacctgtgtcaggcaatgttccgtcacctccagtccgtagccttccagcatggaagccgacaaagcgggactttcctcctcgcctacaggaggcaactgcgccgtgtcgcctatcagcatcagccggcagccctgtccggcatacacatagtgtatcagatcgtccagcaggcggcccgtagcgaacattcctcccgaaagcccctcgttcgcaatcatcgatgcctcgtcgacgatgaacagtgtatgctggtgcaggttcgcgttcattacaaaattatccaactcgttggaaaacgtccgctgccgataaatcttacggtgaatggtataggccggatggcccgcatagtgtgaaaagacctttgccgcacgcccggtaggagccagcagcacgcacttctgcttcagctggtcgagcgtcttgaccaacgcactgattaaagtggttttacctgtaccagcatagccttttaaaaggaaaatagcatcggttttcggggaaaacaaaaaatttacaaaagattcgatagtaatttcttgctcacctgttggtttatagaaaaaatttcgtttaatttgctgcgataaatcattatttaacataaatatctaataaaaagttcagataactttaacgtggttcaagttatttattttatttttgcgctacgaatataaactaaaaaaacaaatattatcatgaaaacagttattaatcttgtgttagctgcctgcgctattgttttggtatacatttgctacggtagtattatgggtcctatcaactttgaaaaagagaaaaaaatccgtgaagatgctatcatcgcacgcttaattgatattcgtaaagctcagcaggaatatcgtacagtacacgctggtgcatacactgcaagcttcgatactttgatcaatttcgtaaaaacagccaaactgccgttcatcatgaaagtgggtgccttgacagacgaccagctgaacaacggtatgactgaaaagaaagcaatggaacttatcaacaaggctaagaagagcggtaactggagtgaagtagaaaaagctggtttgcagaacttccgtcgtgatactatgtgggtagccgttatggatactatctttgctaaaggattcaatcctgattctctggcattcgttccttacggaaacggagctaaatttgaaatggctatccgtaaagatactacaaaatcgggtgctcctctaaacttgttccaggctcaggtttcttatgatgtatatctgaaagacttggataaacaacagctgatcaacttgaaagatactcaggaaaaattgggtaaatactgtggtctgagagttggtgatattgaacagcctaataacaacgctggtaactgggaataacttatttatgaccaacgaaaatatcgattttacaaaatcaaaacaatatacattatccatccgtctgagtacggatggattttctttttctgtctataaccctatagaagaatgtgacttctactttcagacgtatcccgtcaatacccaacagtcaatggccgcaaatgtaaaggcctttctggcgctaaccaaagaactaaaatatacctaccgacagataaatatcctcatccatacagctcgctatacttctgtacctttagaattattcgaagacgagcaaatggaaactatcttttatcaaaatttccggaaacaaagtaacgaaatcattttgtgcaacgtattaggaaaaagtaacttagtaattttgtttccgatagacaaactaacacacctatttttgtcagaacagttccctactgcacgctttttctcaactatcagtcctcagattgaatatcttaccagtcgaagcaaattaggaaacagttataaaatatatgctaatatccatgcttgcagtatggatgtttttgccctcgacaagggtaaactccaacttgttaatacctatgcgataaacgatgtaagtgactctatgtattatctgttgaatatttggaaacagctggcttatgaccaagagcacgatgagatgcatctgaccggagacaatataaactaccgacaacaactttctgaagaattgaaaccatttatccgacaattatttattattaatccgcaagcggacttcaatacgtcgcatacagcacgcatagaagacatcccgtttgacattcaatctttactaatatgcgagtaatcagtggcatttataaacgccgtcgcttcgacgtacctcatacattcaaggcacgcccgacgacagattttgcaaaagaaaatcttttcaatgtactgaccaattatatcgattttgaaggtatcacggctctggacctttttgctggaacaggaagcatcagcatcgaactggtttcacgcggatgcgatcgtgtcatctctgtggaaaaggatcctcaacaccatgcttttatctgtaaagtcatgaatgaggtaaaaacggataaatgccttcctctgaaaggagatgtgttcagatacatggaacggtgcaacgaacagttcgatttcatctttgccgatccgccgtatgccttaaaagaattggctacaatccccgataaaatctttgagcatcatctcctcaagccagacggaatcttcgttctggagcacggaaaagaccaaaatttcgagaatcatccgcactttaccgagcatcggcattacggaagtgtgaatttctctttcttccgctaaatatgctccgcagtttatcgggtaatatgtcccgccaaaggctgtaagaatagaagaaattaccggatatccgaaaaataagggatagcaaaataaaaaaagaaatataaatgatcttgccagaaacgctattatgaagtacggcaggatcattttttatgcctgccacttgtttcacgaaacagctagagcaacggagcaagcagacgaacgacagattccatcaccttatttttccacgagcgctgtgaccatatcttacgcgacaattgcaagcaagatttctggtctgacaagaaaacctccttcagctgctttatggttgccttgtcgtaaaagaatacattagcctcgaagttatgttcaaaactgcggaaatccatgtttgtagaacctaccgaggcaaactcgtcatcggatacccacaacttggaatgcaagaatcctttacggtacaaatagacttttacacccgctttcatcagttcgtccagatatgagagtgatccttcatgcgtaagaaacgtatcggcccgtttgggaagcataatacgtacatcgactccagccagtgccgctatctgaaaggccgccatcacttcttcagcaggcaaaaaataaggagtttctacgtaaaagtaatgtctggcactgcatacggctttcattaatccctgcatcatgtcgtgccattctcccacaggatcggatgtcaccacctgtgcaatggcagttcctctatcgggtatcttaggataatattcggcggacgtaagtaaagtacgttccacgacgtaccagtcggtcaggaatgagctttgcagaccgtatacgccctttccttctatgcgcacatgggtatctctccagataccccatgaaaaccctttaacatacctttctgcgatattcattcctccgataaatccaacccgaccgtcaataacggctatcttgcgatggttacgataattaaccttgctcgtaaaacgtggaaaacggaccttcagaaagctctgtacctcgataccttcgcatagcatctggtcataaaacatcgaatcgaccttccagcatcccacatcatcatacagcaaacgtactttcactccctgacgtgccttatctatcaacaaatcacgcaacaaacgaccaacagcgtcatcttcgaatatataaaactgcaaatgaatatgatggtgtgccagactgatttcatgcatcagtgcctgcaacatggaatatccgtcggtataaatatctacagtattcccctcaaaggcccaggcgtcattgacacgagaaaaaaaagacatcaaatgacttgtaccagctttttccactaatcgctcctgagcctgatattcagccaccggacgtttattcagacgagaataccctttacggctgatcagacgttcctttcgagtgtttctgccaaagaaaaaataaaaagcgagtccaataatcggaagaaaaaaaagtaccaggatccacgccatggtcttcactggattacggttatccaaaatgacgataaatattgttgctaatattacgccaaaatacagtacgttaaatactgccgaaaacagttcgttgataactattgtatccataagacatcggtttaaagcaaaaatacaagaaattctatggaaaagcaagttcagtaatcgacctttttatgcacacgcttacatttcttctacaacggtaacctacacacaccgaatatcgctttgcacatatattgtcaggttaaaacaaaccctaacagaagaagtctcaatctgagttctaacagccttacacaaacattataaagctaaatttcgcagttcagaaaagtcataaaaagccttttctgttccgatagctaatattatgtctaagtaacaaacatcacaggttcttacactgatccgtctttttacgttaattcctgaataaagaactttctttcaaagtttagggaaataaagaataaagcattcttattgttcagacctgctaaaatgcatacttaatcgacaaatccctcaggtttttacgttgatccatcattaacttctttgaaaagcattccacaaatgctgcatctgagtccttcaatgcaaaaataaagagcttccgttcacagctcagaggagtaaaggataaggccttctttttgttcaggctggctaaaatttatgcccggccaaaaatcccccaggctgtaccctggttacaggaattctcacgcaaaagaaaactcagcctggcgggcgcatgcctgaagccgacttatccggtacaaagaaaaaagaaaagagtacccgcactccagcgtcggagttccccgtcgcgtccgggcataaaaaaaggtcccgcagcgtcgttgctgcaggacctcttcaagacggcgactacctactctcccacttgcgcagtaccatcggcgtgacgaagcttaacttctctgttcggaatgggaagaggtggaaccttcgtgccatagtcacctgaatatcgttttatgtattcatgactcacaagcaagcaattccagcacttgtttcaaagctgaaagtatatatcatccatccttatttcaaggaaagtgaacgggcaattagtaatgctcggctttggtgtctccacctttacacctgcatcctatcaacgtcatcgtctttgacgaccctgagaaatctaatcttgtggccggcttcgtacttagatgctttcagcacttatccgatcccgacttagatacccggcgatgcacctggcggcacaaccggtaaaccagaggtcggtccaacacggtcctctcgtactagtgtcagagccacgcaaatttcatacgcccacgatagatagagaccgaactgtctcacgacgttctgaacccagctcgcgtgccactttaatgggcgaacagcccaacccttgggaccttctccagccccaggatgtgacgagccgacatcgaggtgccaaaccactccgtcgatatgagctcttgggagggatcagcctgttatccccggagtaccttttatcctttgagcgatgtcccttccatacggaaacaccggatcactatgctctagtttcctacctgctcgacctgtctgtctcccagtcaagcgcccttttgccattacactctgcggacggttaccgatcgtcctgagggcacctttagaagcctccgttacgcttttggaggcgaccaccccagtcaaactacccaccaagcaatgtcctccatccgggagttagaattcaaacaaacaaagggtcgtatttcaacagcggctccacaaacactggcgtgcctgcttcattgcctccgacctatcctacacatcgcgtgcccaaattcaatgctaagctatagtaaaggttcacggggtcttttcgtcccatcgcgggtaatcggcatcttcaccgatactacaatttcactgagctcacggttgagacagcgtccggatcattacaccattcgtgcaggtcggaacttacccgacaaggaatttcgctaccttaggaccgttatagttacggccgccgtttactggggcttcaattcaatgcttctcttgcgatgacatctcctcttaaccttccagcaccgggcaggtgtcaggctgtatacttctactttcatattcgcacagccctgtgtttttgttaaacagttgcctggacctattctctgcgccctctcttgcgaggagggaccctttatcccgaagttacagggtcagtttgcctagttccttaaccgtgattcactcaagcgccttagtatattcaacccgactacgtgtgtccgtttgcggtacgggtaccatggaagttatgtttagcggattttctcggcagtctgcttacctgcgctgttggattgtcccggaggacgctccatactgtcaagttcggctcttcccgcggatttgcctgcgggaatcagcacctacactctttaacgggctattccgtcagcccgcggcagtgtcacttctgcttctccacgtcaccctccaaggtagtaacggaatattaaccgtttctgccatcggcctcgccgttcggctgagccttaggacccgactgaccctgatccgattagcgttgatcaggaaaccttagtctttcggcgagggggtttctcaccccctttatcgttacttatacctacatttgcttttccatacgctccagagtacctcgcggtacgccttcgacgccgaatggaatgctcccctaccaaccattgctggttccacggcttcggtagacaacttatacccgattattatccatgcccgattcctcgactagtgagctgttacgcactctttaaatgaatggctgcttccaagccaacatcctagctgtcttagcaatcagacttcgttagtttaacttagctgtcatttcgggaccttagccggtggtccggattcttctcctctcgggcacggaccttagcacccatgccctcactcccggggtaaaactgatgcgcattcggagtttgtcaggacttgataggcggtgaagccctcgcatccaatcagtcgctctacctcacatcagtaatccacgaggctgcacctaaatgcatttcggggagtacgagctatctccaagtttgattagcctttcacccctaccctcagctcatccagaagcttttcaacgcttattggtgcggacctccatctggtgttacccagacttcatcctggccaagggtagatcacttggtttcgcgtctgccgccgctgactcgacgccctgttcagactcgctttcgcttcggctgcgggactcgtgtcccttaaccttgccaacgacggcaactcgtaggttcattatgcaaaaggcacgccgtcactccgttaggagctccgaccgcttgtaggcgcacggtttcaggtactatttcactcttctgttcgaagtgcttttcacctttccctcacggtactggtccactatcggtctctcgggagtatttagccttgccggatggtcccggcagattcacgcagaattcctcgtgttccgcgctactcaggataccgctatgcttcgtcttgcttcgaataccgggctgtcaccgtcttcggccgaactttccagatcgttcttctcgcaagatttcttgcaacgacgcggtcctacaaccccacctgtgccgtaacaccggtggtttaggctcttccccgttcgctcgccactactggggggaatcattgttattttcttttcctgcaggtactaagatgtttcagttccctgcgttagccccttactgtgtaaggtaatacctcttcaaggtattgggttgtcccattcggagattcacggatcaggggttatttgcacctccccgtgacttatcgcagcttatcacgtccttcatcgcctccgagagccaaggcatccgccatgcgcccttctttactttccttatcgttcacaccatttttcaacaatgcgggatgatatatacttttagctttcgtactaaaattactttttgcttgttacatcatgtcatagacctatttttctatagtggagaataacggattcgaaccgttgaccccctgcgtgcaaagcaggtgctctagccagctgagctaatcccccgtttttttgcggctgcaaaggtaagcatttactttcgcttgagcaaatttttaaggaagttttttcttcgctcccttttctcgaggtagtcccaggcagagttgaactgccgacctctacattatcagtgtagcgctctaaccaactgagctataggactagcttgcgtgattcagttcaacctcgtctgtttcctgactcggcttcatctttctctctttatttcgttaaacaaactcgcatgcagcacaagatagaaaggaccttcactcggtcacgctccagaaaggaggtgttccagccgcaccttccggtacggctaccttgttacgacttagccccaattaccggttttaccctagggcgctccttgcggttacgcacttcaggtactcccggctttcatggcttgacgggcggtgtgtacaaggcccgggaacgtattcaccgcgccgtggctgatgcgcgattactagcgaatccagcttcgtggagtcgggttgcagactccagtccgaactgagagaggctttggagattggcatcccgtcgccgggtagctgccttctgtacctcccattgtaacacgtgtgtagccccggacgtaagggccgtgctgatttgacgtcatccccaccttcctcgcatcttacgatggcagtctggccagagtcctcagcgttacctgctagtaactggccacgagggttgcgctcgttatggcacttaagccgacacctcacggcacgagctgacgacaaccatgcagcaccttcacagacgccttgcggcttacctgtttccaagtaattcgtctgcaatttaagcccgggtaaggttcctcgcgtatcatcgaattaaaccacatgttcctccgcttgtgcgggcccccgtcaattcctttgagtttcaccgttgccggcgtactccccaggtgggatacttaatgctttcgcttggccgctgacagtatatcgccaacagcgagtatccatcgtttaccgtgtggactaccagggtatctaatcctgtttgatacccacactttcgagcctcaacgtcagttacagcttagcaggctgccttcgcaatcggggttcttcgtgatatctatgcatttcaccgctacaccacgaattccgcctgcctcaactgcactcaagggaaccagtatcaactgcaattttacggttgagccgcaaactttcacaactgacttaatcccccgtctgcgctccctttaaacccaataaatccggataacgctcgcatcctccgtattaccgcggctgctggcacggagttagccgatgcttattcatacggtacatgcaaaggcccacacgtggaccactttattcccgtataaaagaagtttacaatccataggaccttcatccttcacgctacttggctggttcaggctcgcgcccattgaccaatattcctcactgctgcctcccgtaggagtttggaccgtgtctcagttccaatgtgggggaccttcctctcagaacccctatccatcgtcggctaggtgggccgttaccccgcctactacctaatggaacgcatccccatcgcttaccgataaatctttaatcttaattacatgtgtgcttaagataccatcaggcattaatctttctttcgaaaggctattcctgagtaagcgggaggttggatacgtgttactcacccgtgcgccggtcgccatcaaacttagcaagctaagttcatgctgcccctcgacttgcatgtgttaagcctgtagctagcgttcatcctgagccaggatcaaactcttcattgtaaaatatctttttactcttgcgagtacttttgtctctgttcaggtaaccgaatgtctttactttgttcaaatattgacggttctttctttttcaccgcatatacattattatatatgacagctacttcttgtactacatcttcgtttgtttatctaaagtctttcaaagaactatttccttttttgtggcttccgttcgttgtcgaaagcgtttgcaaagttaggagcttttttcgaaaccgccaaactttttcgaaagtttttttcaaaaagtttttttagcggcggaagttgactccgtccggctgccgttctcgctcccttaacgccgttaaggtaagatacttggaccgcctcagaaccgctgcttcctgctccgtttcctttcagattgtcatctcttcaacgtctttccctctcgaaagcgggtgcaaaattacgcactttttcgctttctccaacttttacccacacttttttttcaatttttttgcaagaaaattcataaatcgctgtgtctcaggtatgttttacgacatatttttcggaatgagggaaaggaagccgggaggggtactcaatattattacgcgtgcgcaggttcgcgcgcgtttggttcgtgcaaaaatgagccggaaaggtgaaaattcctgccggatgggacgaaaaatattctggaaggatggtcttctttatcggatgacacgaaaaaaaatccggaaatactccccgaggaagggaaaaaatattcgttcggacggaaaattcattccggaaaatgaggatttttcctttgaaaagccccggaaaaagtgcgaaaatgatgaaaacggggagaaaaatttctcagtttccccacgaaaaaaacttgaaaaatatccggattgtcaggaaagacatgcctgaaaacccgatgacagaaacaaaaaaaagcagatttttcttttgaaaaagttccgagaaagcaaaaaaattatggaaacagacagaaaattttctcagctccacataaaaaaggcaggaaaaattattccgacgaagcgaaaaaatctcagaaaacggatgatccggatgaaaaaacagcagattattttttgcaagcggacggaaaaaatgcagaaaaggatgcgaggcaggacagaaaaatctgccggagcatccgaaaaaatatgaaaatacccagacgaaaagagaaaagatgcatatccggaaggatggttcattctgaaaaaaatggattttttatcaaaagaatacggaaaaaagacagactgatggaaaagaaacaagagaatcataaccgacaaggtagaaaacactcttaaaaaacggataggtaaacgagaaaaccggactctttcactcaaaaaagcagggaacgcccaaaaaaaatccggaagcctgaataaaaaatacgggagatccagaaaaaacatgcctgaattttctccggtttttgtacaaaaaatattctgttttgtacaaattcctgaaagttttgtacaaaaacatacaacagcaacgggagaaaccgaagaaaatatagaagattttttctcaaagcaagctgataaatctagattcacacagggaaaaggcaaagctatcggaaaaataaaataataaacaggaatcaaaacagaataagaattactcaaaaacgataaaacatctcttttgaagctattcaaacaaacagagaaattcataacttccctatctgcaataatccccatatttcaaaataaattcagaaaagtgcgatagagttggatgatataaacaagcgtaatcgcaccctattatcctttatgaaacgaggattaataagatacgattactcattaagttactgatgattatttatcctttaaatttgatagaaaggaaaaaatctaaaaaatcacaactacatcggttaacccgttcctacacagacaaatcaattcaccgtctttttacctttatgccaaatgcacaatacattaagtaagctacacaaagtagaataacaaatagtcctgctgtaatacctcccatatctatagccaatcctaacataggagttataaccccacctccagcaacagccgttatcatcagaccagaaatctgattcatctttgagggacattcttgaaaagccaaagaatatataatagagaataccgaagaggcaaaaaatccaataccacctatacataataaattcattgtaactccatcgacgaacattaaaagcaataaacagatggcacatacgacaatatttatacgaaaataacgtattcctgaaatccgtgccagtaaaaacgttccgagcaatgcgccaatcgttcgactcaaaaaatatatttgaggggcaaacttaacctgttccgctgtccagtcataacgggctgccataagtttcgaactaatatagtttgtagcaacatctactcctacaataaaaaagatgcctaaaaacaagaccaaaataactttattcttcagtaaagaaaaggaatcagacattgaaactacttccgaaacactctgttcacgctggataggtgtaaacattaaccaaagtgcaaaaaataaagtgatcaatcctaacattgggaaacaataataccaatactccgaaccaaagcgtaaggtggcaaacaaaacaatttccggaccaaccaaagaagatacagccttaataacctgccctgctgtcagactacttgtcagcatatgttgattagatattacattattaagcaatggattaagtgatatttgcagtatagcattcccgattccaagcaaaatataggcaataatacaagtcagactgctataaacaattaaaggcaagaacatacccactattgtcaccgccatacttatcagtacagtattcttccggccccatttattcattttattaccaatgggtattcccaagaaaagaaaccagataaaaaccatagacggaacaaatcctgtcattgtagacgaccagccgaaacttgcctgcatgtaatcggaagaaatacccacaatatcacaaaaccccatgacgaaaaaggcagcaagtaccggaattacttttattatcgaattgtttttcataagttaacgaacaaaagtttacatagccggttcagaatgaaccagctatgcaagcaaaacaatgttttatttaccatagtacggaagtacgtctgttccccacttaacgttaggggtacttcccattttcaatttcagggttcctcctttgaggaaatcttcacgatatatccaacaattatttagtggttttccattaaattcagcagactggatataataagcatcgggagtattgttctccacctctatcacaaaagattcaccttttgcatattgaggatccagctttatttcgattttatcgaacaatggacttcctatctggaaggttggcttatcacacgcacccccttgaacatcaaacaatcccatgccagccaatacataccatgcaccaagctgcccctgatcttcatcctgtccatatccatagccatgttctccagtaactccataaaattcatcacatatcaaacgagtccacttttgtgtaagataaggtttacccgagaaattgaagagccatgaaatatgaagattaggctgattaccatgattgtaaggactttgcaagccagaaaaggcataagtaacttttcctcctccaaagaccgatttacgagcttctgtaaagatagaatccaaacgattattgaacaagtcaacaccaacacgtttgattaatccttccggatcttgaggaacaaagaaggtatactgcacagcatttccttcctggaatcctctccaaggctccaatggattgaacttatctataaattctccgttttccaaacgaggacgaataactttatttgtatcatcaaaaagttttgcccatccagtagacaattccattaaacgcttataatcgtctgtctttcccaaaaccttagcccattgtgcaaccgcataagcactgaagctatactctaatgtatgtgaagcagagaaagaagaacctttatcgtgagtaccaaaataaacttcatcattataaggaacatatcctttttcgacgaattgtctgacatccatttttccggctccttcaatacgtcctctccattccagttcatttttcagagctgcctgataacctgcttctacatcaaaattacgaatgccgctattataagcaccagaaagagcaatactaaccatattggttccaacacccgacacatatttacttgcagcaataccgtcgcctagccagccggcatccttatacatcaaaatttgactttgtacccagtctttataatattcaggataagccatagcccaaagattggtcagattccaataggctccccaaattgcatctgtattataataattgaatgcaggagctccatcttgcttaagttggatttttcctattgatccatcatttttaggatatgcaccgtttacatcgcttgccagtcctcgtcccaacaaagcatggtacaagcccgtataaaacttaattcggctatcttctgtacccccagaaacgacaatacgatttaaagcatcattccatcttttcttggctaaatccttagcctcatcgaaagtcaagtcggcagcttccttttctaaattcaacttcgcattatctatagaagtataagacaatcctattttaacatctacaacctggtctttagaagttttatagttcaataccatcatggctccagctccctttatctcggtactatccatgacatcttttcctctatataacacatttacagaattaggcgattggcttagtttagcataaaaatacataggtacagttgcccctgcctgatattttttcacatattcaggctcagtcactacgtatccttctattgtctgtccgtctacctgcttaatgtaagcatctcgtacacttccactttctcccaacttattaccaatatccattataacgtgtgaactatctgattgagggaaagtgtatctttggaatcccactctgtcggttgcagtaagttctacttttatctgataatctttcagtaaaacagtataatatccaggagccgcatattcgtccttcttatcaaagcgtgaacgatatccttcatctggtgtttccagtttacccggaacatttttgatagttcccactgtaggcattaacaaaaatccccctatctgaaactcatgcatacaaggaaatccatcgatagatgtatgcgtttcatcgtatccaacggcttcccatccctgttcattgccatatgtaccattagtagatgcacccagtttggccattccaaacggaacggcagctggcgtgtaaaagaaccagcgactgtgtactgttccgatattgggacgcacatactgcgttaaatcttcttcctgcacaacaggcgtacgtgaagcacaagatgccatacaaagtgctccaattccaatccataaactttttaataaatccatattattatttttttacttcacctttaattaaagcgattcgagtataaagttcaatcatacacgattcatccaacaaccatttaggtttatctgcttcttccgcatttccggtccagtcattatatatcaatccggctttatcacgagcatgcttccatgcccagtcggctgatgcgatgatagcatcaatatatttcgaatttccagttacctcgtataattcttgatatccccggaataatacaacgacaaaccaaggtaaatcttttatgtaaggaacaccattatccgtatactttacatagaatgcaaaactgccttcagctaatctttctgcatcattgagataatgtttatcgcccgtagccttatacagacgaacagccgactgaatcattgttcctgtattatacgtataggcatgcttttgcacttcacctttctccgtcaaccatgaattccaaataatatgcaatgagtcatcttccagatgtcctaacatccaattatagaagcgtttgccttgcgctagatacatggtatcttttgtcgcttcatataattttaaggagagaacagttgcctttccattagagcaagcaggcttctggtctcgatatccctccaaccagggaacagctcctccccagtcatcgctccatccactcattataaaagtcatgacctctttagccttattcaaataggcaacctttccggaagagaaataggcatctatataatctataccaaccaacccattatcatcataataacgatcgacctttttaaactgaaccggataagcctgatatcctgcagggacacgcttgttatcataatatttttcaacagccataaccattgaatcctgataagcggcatatttttgaggatcacattcggccaaaagattgacagcagaaaatattccactcatcggccataaataagatgtttcttgtgctttatgggtagaatcctgaaaataggtcaaatcgggtttgtaagtattaggatagtattcagcaaaaagtccatactgtggtacccgatacttgctccatacgctctgaaacagctcttcagccctatctatataaggagtctccttaggttgcttttggctacaagcagccaaaagcaacaacacaaataccaaaggaacaggataatatattattctcataactgaccattataatataaagccaatacggcataagattcgataactgcatcttgcattaatagctgatatgatctcttaggatctttacctgtccaatcttcatagaagaaaccttcttgagtacgagcatgctcataggcgtaattaatgtagttagcatatacatctatgtattgtttcacattcgaatcatatggagcaatatcaatatatgctctcagcaacttcgtattaaaccacggatcatgatcgggataagccaatccgattccatttacagaacggacaaaaacgccataagatccttgagctgaagcttttgcatcatttaaataattttcatcatttgttatttcatacagacataccccattctgaatcattaccccaacattataagtccattttgtcttgttgatggaacctgacgcatctttactattccagtaacaatgatctgtactatcttccaaatttgttttaacccattcataaagttcctttgcaaaagctaaaacttcttctttacgatcttgcggacaaacttcataatacttcaaaaggaactgtatggcataaccattggcacaagcaggcttgttcgaactctcattgcccggtacatttttcaaagattcattccaccaaattccgccaccgaaaatatcatcttttcctgatttcaagaaatcgactatctgaccggcacgattaagatatgcctcatcatttaaacgttcataggcttccaacagactaagtccgacaattgaattatcatcgtaaaagcgatcagagttacctgacgttccatcagtaccggacccatatccagcaatctgatgagttccattactttccatccaataacacgacagtccatcaatcagtgtttgataatcgacatcatatcctagatcggtcaggaaagcagctcccgtggttaaacaattataaggccacaaaaaagaatacgtaccgtcccccgcttgtgcaggaaagttctcacggtacaaattacccgtcttataatactcttgaaccaaattgaaaacttcatatccccttgcaccataatccactacttcctgagtaggaggtggtgtttgaggtcctgtaggagtccattcttcaacccctgtttcacaagaacaaaacaatgaaatagctaaggcacttgtatatataaatcttttcatactatttttctactataattatttttcatatctcgaaggaatgcttttataccttcgagatacgtaactttttatctattacttgacgtctgagaacgaatgaatcatcataccgtctgcattggtatcgatcgtcactgtacaagttttctggtttaatgaatgactcatcttccacaaatgatcccattgactccatgtaaattcatgcagttcgtagaaagttgccggttcattttcccctggctgttctgctgagatagcatctcctcttccccagcaaacatcagaaccattgatcgttgcaatgaaataataacgttcttcaacccaagtaagccaagatggagggtttgtagtaggatcattcggatcgacaaatcgaatattaacgctttctttcttatatactccattaccagcatactgcatatctgcaattacatcaaaagtagccccccatatcattcttactccagaaataacatccttcgcaatagttttggtattaaaattcaaaatcagtctaacaacattatcttcagcctctacattataagcctcatctccttctattaactttcctgaattgtcaaccgtatagtttacaccattttctaacgcatcggtaaaataaatatttccagcattcaacttagtataaataacaaagataccgtcactttctttacggaaaggaagcggttccattccttgattttctgaagctgatcccagtaagaacaattgttccggaatttcttcagcagggcgtgttacttgaatttcaccgcattcttgtgaacgtctcactatcccacctcgagaagcttccacagtccacttaattttaccggtttccgctgtttttaatccggcctcccgagctattttatttaatatgacatgggtcaatgtaagctgacggtaagccccaaagtcactttgagaagaatatatagggtctgaaaaatctccatcggctttatcgaataagacagagtatagcagaactcctccatcattagcccctccattccatgttaagactatattttcagaagattgcaaatcaatggcaacctccttcgggccagacagttcagttggtaaagtaaaaccttcatcgagtttataatctttggaacatccagccaaaaacaatattgagaataaaaaaatatatatcgctttcatatttatcaccaattaggattttgtgttaaattatgatttaaatctctttcactttgaggtataggccataaataatgcttattggcgtcgaaaactctattttcaactcttacataaccatcatccgttccaaccgcatcacctgtataaaggccgtgacaatagccattcatcactttatcagctatacgccaacgtacaatatctttcaaacgcaatccttccaatgcaagttcagaacgacgttcacgtcttactatttctctcaaattagcagatgtacccgggaacttcaaagcttgttcatccgtaaagccagctctttcacgaagtggacgaatggtattattccaatcagtttctgagaattcacctaattcaaccaaagcctcagcattcataagtaaaacatcggcatagcgaatcaaaataatattcaatccagaatataagttatctctatatgtacggtcccaatatttcttgatataatatcctgtcggtgagcaattggaattgaatccataaccatccggattactacctttatcacaattaattacttgggtagttccatctggcagtatataactattacccgtataacagatggtagcagccaaacgaggatcacgatgctcaaaaggtttagacgaatcataattggcaccagcttcatctatagccttaccattatctgtaatatatgattgtaccagttcattcaaaggagcaagctgagcataacctttcaatgttggaggcaagaactgatattgaatttgctgttcacgatcgggtgatagatattgtaaatccaaaataacctcttcattattctcattagcgacttcaaacagccctgcataattagggaacaagctaaaaccaccttgagtcattatagtagatgttacagctttaagttcttcccaacgcccttcgaaaagtaatatacgagctttcaacgccattgcagcccatttagtgattcgtcctttatcttcggttgagctataagaagctggcaaatagttattatctataacttgatccaactctgctaaaatatttgtcacaacttcagctttgctggtcctagggagctgttgagattcttcaatcgttataacatttgtaaagtaaggtacatcgccaaatcgggaatacaattcaaaataatgaaaagcacgaattaccatagcttcagcgcaatatctattccgaagttcatcacttagtcctgggactttattaatattgttgattaattcattacatgcacgaattccagcataacgactatcccaaacagattcaacataaggataagcagtagagtaactaccatttccgattgactgattaaatcctgtctgaactttcgtatatgcattatcagtcatggcatcagcatataatacttcctcagcgctgtataaagtaggataacaagcatttaaagcatacaatgcagaaccttccttattccaaaagctcaaatcagttttcctatcgtacggttccgtatcaagaggaacacacgccactacagaattgagaagtatccctcccaatatatatttcatcatattaaatgttctcatagttctattaaaatttaatgttcaaccccattgatatcacgcgagaaacaggataaatacgtcctccaccatctgtggtttcaggatcccatccaccttttatgtgactcaatgtaaacaagttctgaccactcaaataaattctcaggttcttcacgtatacttttttcaaccattctttcgggaaagtataaccaatttgggcatttttcaatctcaaataagaaccatcctgaatccagaaatttgatttagcagcattattagtagattctgcacctacagtcaaacgtggataagaagcatccggattattcggagtccaacgatctaaatggaaatcaaagaccggcccttcattattgttatggaaagcttcaacagattcaccacgtaaccaaacattacgtctgcctaccccctgccagaacatagagaaatcgaagcctttccacgtaaacccgtaactaaatccataagtataatgaggaaagttatctccaaggatgaaacggtcgtcgctttctttaaccagcccatcattatttttatcaacatagcgcaaatctccaggttttggagtgataccgtctaaccacggtccttgtgcaacttcttcatcgttttggaagataccattaaccctataagcataataagaatttataggatatccctcctttataattgtattaacatcagctccattaatccattcaacgccacgagtatctactacttcattagcagcatcagaaacgtttcctgaaataaaatgctctacttgtccggttttaaatcggtaattcaaatttacttcccaaccacggtttcttacttttccagcattttgtacaggactacctccaccaaacataccaggaacaggcagacctatcaaaatatcacgagtcacattattgaaataatcagctgtaatgttcaatgcattatcaaagaatcccacatctatacctaaatcgaacatagaggttgtttcccattttatatccgtattaacagctgcaaacgatgctccatttactacgacatttccaaaattatattttggagaaactgtaacagaagacaaatactgataattatcaattctgttattaccaacaagtccccaagaagttcttaacttcaaagaagaaatatgttctttaagcttctcaaaaaatttctcttcagaaattctccagcctaaagagaatgaagggaagagagcagaccgattaccttttgcaaatttagaagaagcatcattacgtaaattggcttcaaacaagtatctttcatcgtaattataattcagacgtgcaaattctgaataaatagaccagtcacttccactgcccgagtttcctacattcgaggtttgagtaccaaccattatgtcaaaatcagaagtttctgtcacacggtaagtatcataccccttatcgctaccaccttcataagaatatccaaccattgcaccaatcgtatgcttaccaaaagacttatcataagtcaacattacgttagtggtaagattcaacgaacgagcgaactgctctgtcattcggttttcagtatcaccagaagcaggagcaacaatcgcctttctattttcatgagtacgattattatacaactgtccaccaatcattccctttaactttaagccatcccaaatcttcaactcagcattcaatgttgcagaaaagtcatcgtttgaattttgacgataacctccctgctccaatcttgccaaagcattcgagttactaccgctcgggaaagtatatgctccattttcatctactattggatagatagccggcatacgagtagcctgttcaataatccattctgtccaataagcatgatccttaacctcattgcgagcataagccacagttgttgtaaaattaaaacgatcagaaactttatgacttaaatttaaacgaccattatatctttgttgaccatagtcaggtcctttaaacatactattttgatccatgtaacccaatgaaaccaaaaaggttgttttgtcattgccaccagagaaagacaagttatgactttgttgaggagcattcttcttgtaaatttcttcaatccatttacagttaggaccgccattacgataataagcaatctgttcgggagtaaaagcagctggttgacctgaattgatcaaagcttcatttctcatttctgcatagatccatgagtccactactttcggcaaacaagtaggagtctgccatccataccgcatttcataggtcacctcatttttctgagcagaacctttttttgttgtaatcaaaataacaccattcgatgcacgtgaaccataaatagctgtagaagaagcatccttcaagactgatatattctctatatccgaaggatttacattctgaatatcaccaataattccatcaatcaataccatcggatcattattgttcatcgtattcaatccacgaatattgatacttggacgagcacctggagcagagttggactgctgaataaccaatccggaagtagtaccctgcaacgcctcaactagatttgttacaggcttaccttcaatttcggatgtcgaaacagaagcaacagctcctgtaagattcacctttttctgtgtaccataaccaacgacaaccaattcatcgatcatttctgtattcgatttcaatacaattatcatatcctttttcaacgcttttccagatatgacctgatctttatatcccacaaacgagatatgtaacttagaagaaggtgttacctccaaagaaaacttaccatccatatcggcaatagtaccttgtttggtagaagtatccaaaatactagcaccaatcatcggttcacccgattcatcttttacaacaccagatacgagccgtgactgttgttgtgccgacattggtattgccaataaaagcaacaaactggccacaaagcacattattacatgtttcataaattaattaagattaaaaagttaataatttccatatttatatgcacctatcgaaaacccgtgacctaaagaaaactaagcttccaattgtgacaatgcataggcataagctcctctcataatagagctacttgctccatcacgactacacatcacagcaatgcgcttcgtattgttgtacggtactttaatagatgttccaggaatcaaaacttcacagtgctgataatccagaaatttttttctctccacttcatcttcccaattgtaaacttccatctgtaaacacgggaattgttctcctgaaaacattgataatgtattgcgcaattcattcaccaaagcaggtaaaatgtaacgagcggccccagtaagcccaccccctataactactaatccgtcaacaatattaagtgcagaagcaattgcacttcctgccatttcccccaattcctgaaaactggctatcgcagccttcctattaccttccttaataccttctgcaatctcacaaatatccttaggtgtcaaattgttatcctctatacccgacaattcacgatacactctttttaccgccctaatactgacactttcttctgcaatcatcgaaggatactttttattgcgcatcaaccaaacatctcccccgcatccattatctcctgtcaacaatctattatctattacaaccccagctccaaaacctgttcctaatgtgattcctaataaatttttatatttacgtttgtgtcccattgcttccagttcagcatttaccataggaagtgctcccgataaagcctcaccataagcaaacaaattcccatcattttctatatataccgggataccataatgatgttgcagaaaaggtccaagagctactccctgacggaaagacgggaagttgggcaaatttccacctatcaccccatttctatagtcggcaggacctggaaaagcaaaactaatagcaacaggtgaagagcctaattcctccaacttactctttactatatcaaatcctgctatcaacgtagccaagcatctatccaaattgtccgaacaagaaggcatacaaacaggagaaacaatctgaatattccccctaatagcagaaaaaacaaaatttgttcctcctgcatcaagggtcaatacggttcttttgtcattctcatacatatttttaaggcttctttaaaggtttatactcagtcacaatcgttcagaaacgtacataagctttgactgtcacacattctttcccttccgacaatccgtaaggacgaatagtatattctcctacacaagcagggataataaaggtttcagcataatgtactacaaacggttcaaacgaatgagtcggactttctacaatagcttcttcaccttccaacagattcagcacgttgacactattattggtatgatgcaatacaggaacagaaaaataatgacgacgagtttcgataaactcattctcatgcaagcctgtacgttcttccttccatccttcgccttcacccatcaaggttacatggttacggagtctctcgtaaacgtagtctgtatttctattccagttgatgacacattttccacgctccacatttattggacgaggtttaccatcaagtcccagacgctgccagtcccacaacttgaaagtaaacaaattgggggtcgagctgatttcaagtaccatactgtttgcacccgaacaatgaattgttccaccaggtatcaagaaatggtcgtgctttttagccggtatcttatttacatacttttcggcatcgaatacaatttcaccacgttgcgctttacgcaaatcttctatcatagcgttgcggtctactccattctttacccccaagtaaacaactgcatcctcttctgcgtcgagcaaatagtaactttcatcctgagtatagtacataccaaaactttcacgaataaactgagtagtaggatgtacttgcagacttagatttccaccacctatcgtatcgaggaaatcgaagcggattggaaaatcttttccaaaacgtgcttcaacaggttctccaagcaattctgtactcttcagcaacacaagatcaaccgaaggcaactcgaatcttacaccatttacttcaagataaagactgttctcttcgggcacacagtcgaaacaccatccgtaattttgtttgcttcgatccaaatcacacacttctttcatccattgtccaccccatggagccggatcgaagaaaggtacgacacggaaaggctttgccgatgttttctcaatacctttgaaaaatgtttcacgatcgatcattttaggttgccctgcaatatgagtatccaaccaaaaatccaccttacggaataaagtatctttataacgatcgcatacacgccagtcattaaaatatcctcttttatactgaagtgaaacagcatcattccgattatctatacctaaagctttcacttcatgccggcggaagcgttgctggatttcccaacgagccatatccacatacacaagtgtagcatctggagcaaccattgatgcccctgtacctattacgataacaggagtatcgatttcctgaatcatcttttgagcagctgccagcttctcgcagtcgaaataatctgccagacacaaattggtgacataaccaaacaatacatcgtctgtcataaaacgctccgtcatccgaagcaaggtttcctcatccttatataaatcacttacaagaatgattttcgaagaagggatcaatgaaaactccttcaccaattcctgctcatacaccccggtataacagtcaacagccagaatgttttttcccttcagtctatctgccaaaacattgcgtatactatcccatccctgaaaaatagtaccacaaatcttcgtactaggatatttatcgtaatttgattttctcatatgcctacataatttgttcatacatattattagtttgtgcaaatatagaaataatattttataaccaaataaagtttaagaaaaaatttttctattatatttgtaactgtaatataaatccatccaatatatgaagatagatcacgacagcaacaagccattacacctacaggcagaggaaattttacgaaatctcattgattcagaagaatataaaaatgggaaattcctccctaatgaagtagaattatcacagacattgaatatttcaaggaatactttaaggcaagccatcaataaattagtattcgaaggtttgttggtacgtaaaaaaggtgtaggtacaaaggttgcccagaaaggaattgtaggaggagtaaaaaactggttgagtttctctcaagaaatgaaaatgctgggaatcgaaatacgaaatttcgaactacatatcagctggaaaaagccatcggaagaaatatgcaattttttcaatatcgaccctcaaaatcctgttaaatgcattgtactagaaagagttagaggtaaaaaagaatatccatttgtctatttcatttcttactttaatcctaaaattccccttacaggagaagaagactatacgcgtccattatatgaactattagaaaaggattataacattattgtaaaaaccagcaaagaaaaaatatcagcgaacttggcaggagaacgtattgcggaaaaactggatataaaatcaacagatcctatattaatccgtgaacgttttgtgtacgacatcaatcaagttcccattgaatacaatataggctactatcgagccgacagctttacctacaccatagaagcagaaaggtaacctttgcgatccatattatataggatagatttattattataagtataggctttttagggaatccaatatgtacctacaaaacctatacttgtttatatattcaacttatatttattatgctttaatcaatgttctcaaactccgtcaatttaccggtctgcgaatcaatgataaagccacgcacaacgatatctttggggactaatggatggtgttttaccaaatgcacactacctctgactgactgctccacattatcgaatccactcaaccaagagtgcagatcaacattacagtattgcatcatttccagttgttcatcggtaactccatgttccttgatatgttgaagcataaccttgctatccatgtgctgtgcaccgcaatcagtatgtccaattatcataacctcctctacaccaagttcatatataccgactagtaaactacgcataacactaccaaacggatgagtaattgtccctcctgcgttcttaatcatcttcacatctccgttctttatacccaatgcagccggaattaattcaaccaaacgagtatccatacaagtaacaatagcaatctttttatcaggatatttgtttgtcagatacttttcatagcctttcttttctacaaaagcacgattgtattccaatagttcgtctatcataattcttgatttttattgttgtcatcgcaaaaataatgaaaaaaggttcagagaagacggtgatatcgttagaaagtttgtacaaaagtttttattttttgtacaaattctaaaaaaacgtcgagacgtttttggggagagtttatggcatttactcaaaaaatcaatcatctcattatttttattcggcaagccttttcattcataatccgataatacacaaaaattccatcataatcagaaaagaacaattaattgttttttgaatattccttgcaaaaagagtactaaattccgccacattttaagattcgttctgaacaagctctgtcacaaacggcaaagctttcacaaaaaaactaaaaacttgaagagaatctataccctaagaggcaccagatttcaccgcatcttaagattcaagcaaaacaaatcttgccataaacggcagaactttcacaataaaactaaaaacttgaagagaatctataccctaagaggtaccagatttcatcgcatcttaagattcaaaccgaacaaatcttgctataaacggcagaactttcacaataaaactaaaaacttgaagagaatctataccctaagaggtaccagatttcatcgcatcttaagattcaaaccgaacaaatcttgccataaacggcagagttcccacaaaaaagctaaaaacttgaagaaaatccacacccaaagaagcacctgatttcaccgcatctaaagattctgaccgaacaaactttgccacaaacggcagagctttcacaaaaaaactaaaagtaggaagggaaatttacaccacaagaagtaccagatttcatcgcatcttaagattcaaaccgaacaaactttgccatttacggcagaactttcacaaaaaagctaaaagtagaaaaggaatttacaccacaagaagcaccagatttcaccgcatctaaagattccgaccgaacaaactttgccataaacggcagaactttcacaaaaaaactaaaagtaggaaggaaaatttacaccacaagaagtaccagatttcatcgcatcttaagactcaaaccgaacaaactttgtcacaaacggcagagtttccacaaaaaactaaaaacttgaagagaatctataccctaagaggcagcagatttcaccgcatcttaagattcaagcaaaacaaactttgccacaaacggcagaactttcacaataaaactaaaaacttaaagagaatccacatcagaagaagcaccagatttcatcgaatcttaagattcaaaccgaacaaactttgccacaaacggcagagttcccacaaaaaagctaaaaacttgaagaaaatccacacccaaagaagcgcctgatttcaccgcatcttaagattcagactgaacaaactttgccacaaacggcagaactttcgcaaaaaaaactaaaaacttgaagagaatccacatcagaagaagcaccagatttcatcgcatcttaagattcagactgaacaaactttgccacaaacggcagagtttccacaaaaaagctaaaaaattgaagagaatccacacccaaagaagcaccaaatttcatcgcatcttaagattcaaaccgaacaaactttgccatttacggcagaactttcacaaaaaagctaaaagtaagagggaaatttacatcacaagaagcagcagatttcaccgcatcttaagattcaagcaaaacaaactttgccacaaacggcagaactttcacaaaaaagctaaaaataggagggaaatttacaccacaagaagtagcagatttcaccgcatcttaagattcaaaccgaacaaactttgccacaaacggcagaactttcgcaaaaaaaactaaaaacttgaagagaatccacacccaaagaagcacctgatttcatcgcatcttaagattcagactgaacaaactttgccacaaacggcagaactttcacaataaaactaaaaacttaaagagaatccacatcagaagaagcaccagatttcatcgaatcttaagattcaaaccgaacaaactttgccacaaacggcagagttcccacaaaaaagctaaaaacttgaagaaaatccacacccaaagaagcgcctgatttcaccgcatcttaagattcagactgaacaaactttgccacaaacggcagaactttcgcaaaaaaaactaaaaacttgaagagaatccacatcagaagaagcaccagatttcatcgcatcttaagattcagactgaacaaactttgccacaaacggcagagtttccacaaaaaagctaaaaaattgaagagaatccacacccaaagaagcaccaaatttcatcgcatcttaagattcaaaccgaacaaactttgccatttacggcagaactttcacaaaaaagctaaaagtaagagggaaatttacatcacaagaagcagcagatttcaccgcatcttaagattcaagcaaaacaaactttgccacaaacggcagaactttcacaaaaaagctaaaaataggagggaaatttacaccacaagaagtagcagatttcaccgcatcttaagattcaaaccgaacaaactttgccacaaacggcagaactttcgcaaaaaaactaaaaacttgaagagaatccacacccaaagaagcacctgatttcatcgcatcttaagattcagactgaacaaactttgccacaaacggcagagtttccacaaaaaaaactaaaatcaggaaggtaatttacaccacaagaggcagcagatttcaccgcatcttaagattccgaccgaacaaactttgccacaaacggcagaggttgttactgaagtaacaaaaatattaaatcaaatcctggaaaattaagataaacaatgttctataacacctccaaacgccctaattaaagagtaaataatttcttaaaaaaaacgctttttactaactttgtcactggagcaatttgatcacgaaacactctttacaaaagttaagaacaaagcaatacagaaaagacagattcacgcagaacctataaaaattattacagcatcagaaagaaatatcatacaatcaacttatataccccatctcgaatttaaactaatactcaatatgaacatgaagtatgcattaagtagtatgctactatgtttcagcctgttctgcttgccaggctgcaacgacaatgaaactccctccaacactcccggcggagaggaaatagaagacattatcaaaagttacgactggcaactggagggtaagtggaaatatgcttcgggcaatgacagtgatttttcccagacactcgttttcgaaaaaaacggcaaagggtcttatgatgacggtacactggaatggtactgttccaacaatcaattgtacattgattttgacaacggcaaatccataaaagattgtaactattcgttttatggagcaactcttcagttgaaaaatccccaactgtcgtatatcctcgattgtccttttatcggctcctggcttgcaaccgacgcacacaaccattttaccggctctactttctattatactttctcccctgatggcagtgccgaatgtttcaccttcaatacttccggtatttgggaaagtcagaaatactcgtggttcagaacccagaacggtatccaactgctattcaatatgactactaccaaggacctcatctgtcaggcggatgcagagaaactgacgatacaaggcgacggagaattcaaccatgccagtccgttctatggcaaatggaagtccgtctattcacagaatggcatcattaacgaagaagatgagaacttttccaccatcgagctttaccaacgaacccatgatgattatgtctactataaggatgattactttgtatactataagaaagataacaaatatgccagcttccaaggtctgatgtctatcttgctccccaacagaagtttattaataaaaccagccgatggcaatgaccctttgttcctctatttccgtttttattattcaaaagattcaggaaaggtttatctggaactaagcaaagacaactcatttacagaatatacaagatatgaatttgtaacagcattatgagcatgaagaaagcgatactactacctatgctgtgcctcatcaccttatgtggatgtgaaaagagcactgaattatccgaaatcacaggcaatacagggaacagtgaaaaccctgaaacagaaacgccggaaaacggaagtctgacctttcagttgcatacggataagacaacctgtaacttgctggatctgaccgttttctcaatttcgttcaatcgtaccgtttccatgctggacatatcccatcagtttgattcaattgcatggatagtagaagataaagacaaaaatctccactcattctgtatcatggaacaaaataaaaagtttttccaatggagtcactgcttttattatcccggcgagtataaaacatacctggcaggatataaagcccaaaaagaaaccttcagaagtgatacactcgacctgcaagtcgttacaaaagactttttaggatggaaatggaacgaatttcccaatgaaacagggcaaacggggacaggtaccgtaaacctgttcaacagtgacttcgaattgacatattataatcagctgtccgacaatggcgtaccagggtggaacctttacgtatttaattctgccggagaagacgaacaggcattctatgaaaaatcatccgaagcactttaccactacataacccaaatatacggtgctccttccattgacagaaattcccccgaactgacggaagcatttacagccgattttgattatcatcctgactatgcaactcctctggctatttgggaaacagaacagacacgcatcgtacagcttcggattgataaaaattggccaacagctcgcatctatacggaaccgctttccgaaaaatgatctgcctaataaatgacaacaatcactccattttagcatggataaacttgacttaaagaccgaaaacatgaaaaacaaaaaaagctgattaagagtctgttgccttaccaagagagctaaaagtggtacagctcaaaggtaaaagaaaagatgacgccaagcccttttgctgagattgttatgtagttagtttaatatcagagtatgactaacggtttaacaatttttatcggacagcaataatatctataagttacaatatacaaatctcctgctttagccttcattcatttatatggctaaaagcaggagattttttactattaagtttcaatctatacgattgttactctagcaattttcagaaggtcccttaaaaattctgtagttacattcctcattttcaagaggatctctttggtttggaccattttccctttctcttggtatcatgagttgcctacgtcttaaaggcaaaaccccatcttttccaaaagtaagttttgatatacagtcacccacctaattagagcaagaaagataaaaccttatttttcagtcaatgtaataccatccagacagaaatagttcggagtattcatgccataatctcctgtatcggtagattccatctcgaaagtaacataagcagcacctgccagcggagtccagtcgaaccattcccaagtatttacaaccgagttctttccatcgcgatagtcagccaaatagaaagtatttcttcctacttctttaccagaagcatcatgaccgatagctgttactgtaaaataatctccatcggtaaagggaccttttaccactccactgccatcgtttccatcttttattgccagataatcgtaagtcgtgttggtaatgtaagcacccttgaactgatacttatctgtctgcaagttatccaattgtgtaggattcgacaatgctacggtaagatatacactaccttctttacccttacctgttatcgcactgagatttaaatagcccggagtagttacatcggtggtattagtatatgtaaatccgccaccgaatccccagtcgccaaaatagctgttacacttaactaacgatttactgtctgtaaacgatgtaaccttataccagtcattgtatttttcaccttctgtaggagcaaacgccgtgttagcttctgtcagcttgtcttcgaaactaactaccacatcctgcttttcattcggaactgtcggttcatcatcgttactacaactccacaaacctacgcacaaacatgcgtacaaaacaaaaaataactttttcatttgtcgttcaattaattaatttaataaatatagtttactattcatttcttataatgtaaattttctactccggtaatttcggtagaaagctctcctatctgtccacaatattggttgaccgccgtataaatcttcacgaaatcaatctcatcgagagctaccttgttaccctgggcatctaccgcccagtctatcttgaacttcgacatttccgtactgttggggtgattatcggcatatccccagtcgtaagcatagcctacccaaactccattttcatcaacggcattgtctttcagacgcgttccacggaacgtcaagcggtcactttcttcccaaagcggataatacgatgcctgctgatggaacgtattccgatacacatagccctcgtttccctgattatccgtccagcgcacatccgcattttcgggctcaggacgataataggttatttcgtaattacgaatttccgtatcctttccgtattcactgccagccagttcgtaccatgtatcatcgggctgaccgttgccgttctcatctttcgacaccaatacgatacccggttcggcacttcctcccggacgatcctgccaggcattcggattgtagttggcattaccgtaaatcttgaaatcgtactctccggcgacattcggcacaggctgagaaaagcccaacacgatatatcctccatatgcccccaacgataacaaggacttcttctgaagccgctcggtggcatagtccaatacctgctgtttggtagtaaagccttcaacgtaagccgtagtagtcgtattcatgtactgcgtaggtgccggaacataatcgagcaccttatcggcataggcagccatcccgtccgaatcatccggattctccggcgtatcgacattggcagcctcatcgcggaacagcacggtattcgggttcagccctaccccgctcaaacggaacatgagctcaccctcaggcgtgaagcacaacaaatcaccgtctacctgataattgtaggcttctgtgatatatatattactgctatacggattcacctgaatggaaaacggacgctctatccgagtcccatcggtgatgaactgacttctcaccacttcccctatagtcagattgaaaaccttgaaggccgtctgtccggtagcgtaatcgtaattatagagataagccgtgttgtaatcgaaggcaaagtccatgaccggctcatcatatatcttttccactacatccgactgcgtgtttatcttcaccagcttatagtcgccttgttctatctgttcgccttgagtggcgacccacacactatgatcgggaccagccaatattttccccggattgggaccgacctctatcttcttgctttctgtaaaggtcgacagatcgacaacagaaaccgtacggtctactcctatcccagcccagtccaatcctccggaattggaaacgtaaagtttaccatcctgcacacacaaatcctccggattacgacccacttccgtgatgccgtctatctccagcgaagtcgtatcgatacgggctactgttccatcgtaagaacagacataggcctttccttcttcaaaagcaatagcacgaggctgacgggaactaccattatcggccagcatcggaatctgtttgatggaaagccctgtctgaagatctaccacctctaccgtactcgaaacattcacaactatatacaacttactgccgtaaatatccatgtcattggccgtatctcccagcccacgatgattcagcgcacggaaataatcgtacgaacaagtcctcgtctgaaacgaataccttgccagcgtactgttgttcaggttaaacagtccctcgttcaatatatacatttccgccgttccgtaatcctcgactaccccgttcgcctcatctgccacataagttttatcttccaaatcgtcgcaaccggcaaacaggagagccagcgaacatactataaataccagcttcttcatgcacatcaatatttaaccccgaccgtgatacggaaagaccgtccgggcatcgggaagtttttcacaatttcataattcttattcgccagattcagcacctcggccgacagggaaatatcagtctttccccatcgaaaactacgatgggcagacacactgtgatcggtatatccattcaaccgattcttggatatattctgtcccagtgcataacgcttacccgagaacagcatggagtacgacaaatcgacccacggcgtttcgagtaccgcctgtccggagcccgaggcacgcggtgtatacgctatctgatgcttataggtctttccttccagcgtagaagggtccggattggtgacatccagtgcccgctggtacgtataatttcccgacaaagtcagcacatacttctccaccggttgtatgctcaggctagccgtaaaatctattccctttatatcgaccttaccgagattgaccatgctccagataaacagattcttggtaggtatagccactatcttatctgtcacccggttggaataagcatccacagtaaccgaaacataaggaagccagtcggatacacgcttgctgtatgtcagcccgacattgagctgactggcattttccggtttcagccgaatgttccctgtctgtccgtaatacaaatcattgaaactcggcaagcggaaaatatctttatagaaaaaacgaatacgaaaatcttcggaagcaaacggcttaaacgatacgctggcatatggggacaatttcctatgccctccggcactattacctttggctacatcctcataaaccactgtcgacaacagagaagccgaaagcgtcatccactcattgacgtacttgcccgccagcgcggtgagccacgaatagcgtacaggcttggcaaaatctttcaagtcgcagttcatgcggttaacacttccgtcggtcgaaagagaaaaagaaagacaatccaacgcacggaaaagtacggctgccgaaagataatactcctgctggaaataactgttttcactctgtccggtagttcctttataatcagggtccagataatgctggtacatccagttccacttacccgatgcctgaaaggcccacttacggttgaactctttcttatactggctttggacaaacatattcttgtcccataaatgctgggaggaataatcgtaatacagtgtagtcgcattagggagtccgcgagatgactggtaataataagccttcagcctccactgctccgtatcagaaaaattaccaaacaagctggcctcagcacgaaaggtctgtacatcggtatttttacgcttttcacggctggactgatcgccttcatcgccataatataaagtataagggtagtgcccgtcggacgacatccattcggcattggccgtcagcgcccatttcgttcccagcttctgctccagcaagaacgaaggattcagcaatccccacgagcccgatttcagcgaagcactgagattcgtcggcttattgtcgtgaaaaacaggagtcagtgtctggatattcaagattcctgccgaggcgaaaaatcgcgcaggctgaaaaatctggtccccctgtccgttgcttagtatcagacggtctacgttctccaacgaaaaacgcccgatatccacctgaccggtctgacagtcggttacagcaatcccgtcgtatcccactaccgtatgctgtgctcccagacttcggatggaaaccgttttcagtcctcctatccccccgtaatcttttaccgttactcccgaaaaatgtttcacggcatcagacacctgcatcacattcagcgtcttcagttcctcacgggaaaaaatctggagaggagcggccgaacgtacttcacgcgtctggtaacggtcggacaccaccacctccggtatggaataaaccttcgtggtatctatatcctgtccgccataacatctcgctgcaaaaccgaccagcattatccaactacatacgatatacttcattttttcatacattataatacagccaacggatttctccgcttctgcgtcgcttgcgaaaataaagcatcggggtgaacagaaagaatatgtaccgacagatcatcccacgctttttcctcgaaagctgtgaagaaactatgcatggcaggtcttctgactcattcctattgcagactaccttcccggaaaatcattccagtggcttgagcgattgcctgcaatatacacggaatttacagcagcgggactgttcaggacttacacctgattcccttttaatcatcagattatccagtgaaaaagagataaccttttgaaccaatgcgtcacaaaggtagaaagttttttcaataagccgaaaatattccgtaattttgtagacaagcaactaaaacatataaattatggcaaaagaactcgaattgaagtacggctgtaatcctaaccagaaaccggcacgtatttttatgcaagaaggagaactgcctatcgaagtattgaacggacgtcccggatacatcaatttcctggatgcactgaacggatggcagctagtgaaagaactgaaagaagctaccggactgccggccgcaacctcgtttaagcatgtgagccctgcaggtgcagccatcggtctggaactggacgatacgatgaaaaagatttacttcgtagacgatcttccactttctccgctggcaaatgcatacgtacgtgcccgtggagccgaccgtatgtcttcatatggcgatttcatcgcactgagcgatgtgtgtgatgaagctactgcccgtttcattcaccgtgaagtttccgatggagtgattgctccgggatatacagacgaagcgctggaaatactgaaaagcaaacgtaagggtacatacaatatcatcaagatagatccgtcttaccgtcctgcaccgatagagcacaaagatgtgttcggcattacattcgaacaaggacgtaacgaaatcaagctgaacggtgacaatctgtttgccaacattcctactcagaacaagaacttccccgaatctgcacgccgcgatctgatgattgccctgattacactgaaatatacacagtcgaactccgtatgttacgtcaaagacggacaagctatcggtatcggagccggacaacagagccgtatccactgtacccgtctggctggtaacaaggcagatgtctggtatctgcgccagcatccgaaagttctgaacttgccatgggtagaaaaaatccgtcgtgccgaccgtgacaataccatcgatgtctatatcagcgacgagcatgacgatgtgcttgccgacggtgtatggcagcagttctttaccgaaaagccggaagttttgactcgtgaagaaaaacgtgcatggctgaatacactgaaaggtgtttcactgggttcagacgcattcttccccttcggcgacaatattgaacgtgctcacaaaagtggtgtggaatacattgcacaagcaggaggatccgtacgtgatgaccatgtaatcgctacttgcgacaaatatggtatcgccatggcatttacaggtatccgcttgttccaccattaataaaccgcaataactcacaaacgagaaaggcggacaacaccggcactctttttccggttgttgtccgcctttctgtttgtctgttccttcactcagaacttatatcctaccgtagcgaaaatagcgaggttacggggaccgtttttccacatgcgtgccaggccaaattcgccctccacacctactaggtaatgacggaagtcgagatttatacccgcctgtataccggcatcaaagcgacgaaggccatcccatattttcacattattcagacaagcatcattgaaagtagcccaagatgaagtcacatcatctgccttctgttctgttttaccgacaatgccataaccgatgtatccacctccagctattactatatcaaaattcttgggagtaccaatatgaaaagcagccagaataggcatttcaaaataattctgattgaccgtttgctttgtatcacctaccaacgaatacttagcgcctttcgaagtccagttcaatcccgtctgaaaagatacccacccggtaagcggtatatccactcctactccgatgcgctggttaaacaaagattttgatgagccgaatccatctcccatccacgaagacgcacccagacctaattttacattccacatcggacgttgtgcattgacaagcatagccgacagcacacataaaaccaagagatacagttttttcatagtcaagaccgtttattgttgagataataagaatagatttcacccagaagcctgttccctacaaagtccgtgagaaaagcttctagaaacaaatataatcatatcacccaacattcacaatcaaacttcaggaaaaagaaccgaaaagcaaccataatgactagaatatccgacctttttacatctgcacagccctctggcaaacataaattgtccctgacgcaagggaatacaatccattgcaacagggacaatccaaactcaaattgctcaggtgtgctacctgatcatatcattcattccagtatcagaactcataatcgataccgatagaaatgttctctccatcaagtgttacaccaaatccgtcggaacctctgaagtaatcgtcacggtaaccggcgaaacctactttggtaataaagctgaagctatcattcaacttgatggccagtcccggcttcaacccgatttcgaaaccgttcacagcatctctgtgctcagcttttgatgtagaaaatcctaatcccatatctatgaacagacgtacgattttgttttcgtagaaagaataacgagcgtacggagcaatggcaaaactattgacgtgtgatgaaattctgtcttttccctcatcgtaatacgttccttcgtgagcatatgccaattcagctccaattgcccagcgttcattcaggttatagccaaaatcgggtgagatagagaatgaattgatgtcggcatcacaatctctccaaagactgataccgcctcccaaatacattttctgtgcatacgatgacaaagcagccatcagcacaaccacaagcattaaaacttttttcatgattacattaaaattattagttagttatacaaaaatatgtcgagcgctctaattgccgcctcatccgtttttatggcgattagcacgtctgcggcgatattcagctttcattttagccgaaccggacccatgcaagcccgttatataagtttttttcttagccttcgtctttactttctcttctttcttgaccgaaggcgacttgcttcccttgaaaataattccttctgtaagtattttctctatatccatatatctattttttatccattattttttaggaaccagctttacgtgattccctgttttagtacaaataagcgtacgcttcaacggagttcccgttttcatatcaaaaaggactcccggattgatatgctgtccgttcacccttatttcgaaatgcagatgttcggtggtagcccgtccggtacgtcctgtcagtccgacaggctgtcccgccttgaccgtatcgcctaccgctaccagatttttcgagttatgactgtaaacagtttccagtccgttggcatgacgtaccacgactaccttgccgtatccgccataatgctttgccatacgtactatcccatcgaagacacagcgaatggtatcgttcgcacgagtcttgatatccgatccgctatgtcctccccgtgagccataagcagaaatcacttttcctttcggcaaaggaaagcagaaggcagaatccgccagactgtccagatgaatctcaaaactgtttcccttggcaaaaagttccggcgtctttacacgaatatgattgcgttccatttccgaaaacactttcgtcttcggttcggcagcatgtacagacagtacgcaacccagccatccgcacaataaaaatcctgccagtatgatctgtttcattattcaaaaaatacaagttccacgtcgtgagcgtcggcaaactctttcagcaagccgatcatataatttacattatcctccagtccttcactgccgctgtaaccattcataatagcaagcagatgtgtggtaccttcacttatcttcgtgcgttcattatcgctggtaggagttcccaccccccctacagcatcacgatataccggcataccttcgatgttcagttcgccacgcccgattccctcgtaaggttctccagccttgccgatacccaacaccagacggtcgccctgtatcttgtccagatcgaatcctccgatggaatgtccgctatagatggaagccagattaatcaggtcgaccaacgtatctatctgatacaaaggaattcctctcaagatacgacgacaaagagcctccgaagaaggacgatagcggctaggatcctttccacatttcttataagcctgtcgagtagtctgaatagccggcatttccttgatggagtcggttgtatatttcgagcgatacaaagctgtaaactccccgatacgtttccacagctcttcgttgtaggctgtattttttaccgtagcaaagactgcggctccccgaaactgaggccatgcttgcttcagttcatcggatacttctatggttaatttcttcattgtacactgatttttatttttcttctattaatcaaacctgtctaaaccaacaagcggcaaaaaggcagacaatgctaaacgtcctccagcataatgcctgaaagaatgcgtcccgacgctattccctgccggcgtgcagagaagaaatcggcattttccttccaagtacaaataccgctcacctcaatattcgaaggcaacaccccaaaatcgagtaactgcatgcggttcgcttcccacaaatcaatatgccatttgtcccgacgcgaagcgatgcgctgcatctcgaatccgttccgttcgaaacagtcgtatacttcatcgccaacctcaaaagcctccagcgatatgctcggaccgatacatgcaatcacatccttaccctgagtaccataagtgcaggacattacctccagagtcttagctacaatacgggcaaccgtacccctccagccggcatgtattgcagcaacagcacgatgtttcacgtcgaagcacagtacaggaacacagtcggcagtcgatatgcaaagacactctccggctacatccgtaaccagcgcatccactccctccagcagcgaagccctctccgtttccggatggctgagaaattcacggctgactatccgcacttccgtacggtgtacctgatgtggaataatcagttctttcttctttcccggcaatagagagcaaagcaactccctgtttttctgcacattctctggcgaatcgccacagaagccattacagttgaaagaagcatattcccctgcactatacccaccatgacgagttgtggagaaacaaaaaatgccggggtacgatctcatcaaaccatactccaacattcttttatcgtttgaatactgcatcatcatttctgcggttcgtcgtcccagtctacttcctcatattcgtagtcgaaatcatcctcatcgtcagcatcctcgtactcataatcgaagtcttcgtcttcacccatttccttcagttcttcctgaagcttggtcacatccttcgcacggtgcacgatggatgcctgacgaagtccttccagacggttgctgtctttgttcaattcctcccacaagatatctttcaactgctgaatgcctatattggctacagatgaaataaacacatgaggtatattttcgggcagtgtcggagtcagcatctctatcagttcttcatccagcatatcacacttcgtaatagccagtacccgctgcttgtcgagcatttccggattaaacttagccagctcgttcagcaagatatcatactcccggcggatatcatccgtatcgcccggaaccatgaacagcagcaacgagttacgctcgatatggcgcaggaaacgaagtccgagtcccttgccctcacttgcaccttcgatgatacccggaatatcagccatgacgaacgacttgccgtcacgataggaaacgatacccagattcggttccagtgtcgtaaacggatagttggctatcttcggacgcgcagccgatacggtagacagaagagtagactttcctgcgttcgggaagcccaccagaccgacatctgccaataatttcaattccaaaataacagtcatttcctgcatcggttcaccgggttgcgcaaaacgcggtgcctgacgggttgccgtacggaagtgccagttacccagtcctccccgacctcctttcaacagaatgacttcctgtccgtcttcggtaatgtcgcatacatacgcccctgtttcggcattgtaaacaactgtaccgcacggcacttcaatcaccttgtcggcaccatcctttccgaagctcttgttcttcgagccattgcccccatgttcggcaaacacgtgacgttcgtactttaggtgcagcaaagtccagtaattgcggtttccccgcaagataacatgacctcctctaccaccgtcgccaccgtcaggacctccgttgggcatgtatttttcacggcgcatgtgtaccgagccgcgccctcccttaccggagcggcagtagatttttacataatcaacaaaattcgattcagccataatattttcttgaaaaattaaaaaagccgaccgtcatccaaacggtctacagaaaaatatatggatttccgactacacttccagccggtccatattattaagtaaaaaagagaacgagaaacttcccaacggaagttcctgcattctccgtttttatgttacttgattaaagtttgtcgatagcagtgcagatatctgcaaagataccatccattgagcccagaccgttgatgtggcagtatttaccgtcattcttgtaccagtcaatcagaggagcagtctgagaatgataaacaaccagacgtttcttgatagtttcttcgttatcgtcggcacggccagattcttgtccacgtttaatcagacgagtcatcagttcatcttccggaacttccaggtcgagcataatagaaacttcttgaccacgaaccttcaacatttccttcagcgcttctgcctgagcgatagtacgtgggaaaccatcgaagataacacctttgctatctttgaagctatcgaatacgctagccagaatatcaatcatcaaagcatccggaatcaactgaccgttgtcgatatatcctttggcagtcttgcccagttctgtaccgttcttgatttctgcacgcaaaacgtcacctgtagagatgtggttcaagccgtatttctctacgatacgcgcactctgagttcctttacctgaacccggtgcaccgaaaattacaatgttcaacatctttattacctttatttaatttatgattaattattctattaccgtataaatgtcacgatagttacgtcccagtccgtcgtaatccagaccatatcctacaataaagtcattgggaatgttcattgccacataatggatatccaaatccaccttcaatttatcaggcttcaccagcaatgtagcgattctgatttccttcggattacgtgcacgaagcgtttctatcaactgcttcatggtaagtcccgtatcgacaatatcctccacaattacaattgtacgtccggtaatgtcatcgcccaggcctaccagttccttcacctttccggttgaagatgtacccgcatacgaagccagcttcacaaaagatacctcacaaggcatagtcaagtgcttcatcagatcggcagtaaacataaacgagccattcagtacacttataaaaagcgggttggccccagccaaatcacgattgatttctccagccacacgggcaacttccgttaatatcttctcctcaggaataaaagtcttaaagcgtttatctttgatctgaattacactcataatatataactttataaaattgggacaaaaatacgaattatccctcaaacttctatacttttttcgtacttttaccgacaaatagctattgagaaaaaagatgaaaatacttagttgcactcaacaaaaggaggcggatgcttacacaatcgcccaagaaaacatactttccatcaacctgatggagaaagcagcgtcactgcttaccgaagaaatttgccgccgatgggacaaatcccaccgtatcgtcatattcgcaggttcgggaaacaacggcggtgatgccgtagccgtagcacgtatgctgtttcagaaaagctataccgttgaagtttatctgttcaacattacaggggtattgtcggacgactgcatgaagaacgtacaacgcttgcaggaatgcggatttcccaactatcatgaaatcagtaccagcttcgatcctcctaaactgaccaaagacgatgttgtagtagacggacttttcggctccggactcaacaagccgttaagcggaggatttgcgtcggtagtaaaatacatcaatgcttcacagtctaccgtcgtttccatcgatctgccttcgggcctgatgggagaagacaattccaacaatatccgccagaacatcatccgtgccgatctcaccctgagcatccagttgcctaaactgtctttccttttccccgaaaatgaagacatcgtaggcgaatggaaactgctcgacatcggcatcagcaagaacttcatcgaacaagctactacgccttataccatcaccgaagccagcgacatacaccagatgatcaagcctcgcggacgctttgcccataaaggcaatttcggacacggcctgctgatagccggttcgtacggtatggcaggagcttccgtactggcagcccgcgcttgtctgcgctcaggcatcggtctgctgaccgttcatacgcctgtccgcaaccatgatattgtacaggcaaccgttcctgaagcaatggtacagaacgacgtacacgaactttactttgccgaacccgtagatctcgacaatttccaggcacttgccatcggtccgggactgggacaagaggaagaaaccgcactcgctaccttcgaccagctcaaggagtgcttcataccgctggtacttgatgccgacgcactgaacatattcagcacacatcgtaactacctgaaccggataccgaaacgcaccatcctgacaccgcacgtcggagaactggaacgcatcatcggaagatgcaacaacagtttcgagcgactgacaaaagccaaggaacttgccacttaccttcagtgctacattgtactgaaaggggcctataccgttgtcatcacccccgaaggtaactgtttcttcaaccagacaggtaatccgggaatggctacaggaggcagcggcgacgtactgacaggtatcattctggcactgctgtcgcaaggatattcacaagagaatgcctgccgaatagccgtatatgtacatggtctggcaggcgatatcgcccgtaaccgggtcggagaaatcagcctgacggcaagcgatatcatagatgctctgcccgaagcatggaaaaacattactgaaactaaataacaaaccactatgaacagaacgattattgcattggggttgttggcatgttcaacacacatcgcagcacaagatgtaaacatatatactccgggcagcgatgaaggcatcgtatatttcctgcccaagactgcactggaagtgaatatcattgccacacgcatcaattaccagccgggagaattatgccagtatgccaatcgttacctgcgcatgaacaatgtaaatcctcagccggaaacctattgggagatcaaacaaattgatgtccgctcggcaggagtacccgattcaaccaaagcatatattatcaagctgaaagacaaaagcgtcttatcaaatatagaactgaccgaagacggtatcgcaaaggctatcaatacgacttttccgaaggaatacgaacaaaataaggactacgagctagagaaacctctgccgcacgaaaacagccgtaaatatatgacggaagaaattctgatggcgggttctacagccaagatggcggagcttacagccaaggaaatctacaacatacgcgaaagcaagaacctgattctccgcggacaagctgatactatgccgaaagacggagcatcgctgaaattgataatcgataacctcgacaagcaggagaaagcgcttacgcaaatgttcgccggtacaaccgaccgtgaggacaaggtatttaccgtacgtgtcactccggaagataatataaaggataaaatcatcctgcgcttctcccgtctgctgggagctttgtcgacagataatctggcgggcgacccgatttacatcagcataaacagcacggttccgctgccggttgcaaccgatgacagcaagaaaaagaagaaacccgaaggagctctctacaacattccgggtaaaggacatgtttctgtcagctatcagggaaagaaatattttgaagacgacgtacctgttactcagttcggttcgacagaagtactggtaaacgacttgttcaacaagaaagtaaatactcgtgtcgtgttcaatccggctactggtgccatcctgaaaatagacaaagactaatccgaacacaacaaaaaaagtcatggggctgtaccgttcgattccctgaaacggtacagcctcattttcttttactgtagtaagtttttcatattacataaaaaaatacctcagcaggcatccacccgcagaggtattctatatattctcaggaacaattctgttccttgcttaaagtcgaaaggcaattacttgatgttagcttcttccagcttgtatccgaacttcttgtcggccaccttcagtgcaaaggcaataatcagcgacagtactgcaagtcctgtaaagatacacatcggcaacgtataatcgtacagattggctccgttcacctttcctactacacaatatttatccagcacaatacctatcaaagtcggtatgccccacaatccgatattctggataaagaaaatcaatgcataagcggtacccagctgatgagcagggaatatcttggcaaccgaaggccacatggcagaaggcaccagcgagaatgcgacacccagtacaatcatcagtacaatggcaatcagtgaactcgtaacgaaaggcaaagcatagatacagtgtacgccaatcagcatggcagcacccagcatcatgatagaggcagccttaccacgcttatcgaccattccaccgaataccggagtcaggaacaaggcacccaaggcaggaagtccggcaaagaatccggcaacgctctcatcgataccatatttgctgatcatcagttcggaagcaaacttctggaacgggaatacacatgaatagaacaatacacagagcagggctatcagccagaatcccgggttagaaagaatcttggcaacatccttgaacgagaacttctcttccggagaattgtctacttcagcttcaatctgacggtcgagtttcttatccaataccgagaatgcgaagaaagcaatcaagccaccaaccagacagatcagacctaccagtaccggagtcgtaatttcgtacgcacgtgccatcgggatagctaccgcatacgcagcctgcgaacccacacgagccagtgctacctgtacacccatggctgttgccatttcctttccatggaaccatttggcaatcatcttggtaacggtaatacctgctacctccgctccaactccaaagaccgaataaccagccgacgccacaaacacgcttaccttatatccaagtatcgtaccggtagcatctgccatgcctgtcatggcataatattcaactcccgtacccagcaccatcaacacggtagccagctttccggtaaaacggataccaaaacggtccagtatcagtccaccccaaatcagcatcaggaagaaaacattcaggaaactgtatgcacctgtaaagagtccgaactcactgctgtcccatttcaaatcggtttcaagcatcgtcttcaacggtgcaacgacatcattcacataatacgcagccatcatcgtgaaagccacgatagccaatgccccccagcggatcgcccgggaatcattcagtcttttgagattctgttctttcatctatttttatctgttttttatatatttcttaaaaatgcgacaaagatacgttttttttcttcgtttctatttcatttttcaaaatatgttctaactttgtaacagaacgtaacacacatttacgataaaacgcgtgcaaggttcactctatttttatttacctattaatttaagatcaaccatgagaaaaacaaaagttacggttctttgcgccattatgagcggaagcctgttattttcttcctgcatcggttccttcgggctgtggaacaagctgaaagattggaaccaaggactgggtaataaatttgtaaacggaatcgtattcctggcatttcatatcgtaccggtatatcaagttgcttacctggccgatatcattgtactgaattccattgaattctggtcaggatcgaatcctgtagctcaggtaggtacagaaagaattattcagggagaaaacggtgaatatctggtacgcaccaacgccgatggctataccattatcaagaaagatgaagaagacaaacctctcgatttggtatacaacaaagaaaaacgtacatggaacgccgttgccgaaggacaaacattcgaactgattaccatgaacgaagacggaaccattactttcaagcagcaagatggtactccgatgactgttactcccgatatgatgggattgtctacagcccgcgcaacacagaacggttcattgttctttgcagccaaataagcaatcagacagataaatacatacaataacataaaaagtgccgtagttcatcatacagaactccggcacttttttgtttctgctccttcttgctgcccacacatgccgaaaaggaagcatcagcacgccgggcaataaaaaagcagcctctccaccacggagaagctgctcattattattataattaaggtgtataaagtctttattatctactacctgttattagcactgagccagttttccgtctgaacccaatacattgatgattttgtgcttgtaaagtttttccatgttgtcacgagccgggcccagatatttacgtgggtcgaattcagccggtttttcagcaaatactttacggatagcagcagtcatagccagacgagagtctgagtcgatgttgatcttgcaaactgcagatttagcagccttacgcaactgatcttcaggaataccgatagcagcttccagtttacctccgtatttgttgatagtatcaacttcttcctgaggaactgaagaagatccgtgaagaacgatagggaatcccggcaatttttccataactgcatccaatacgtcgaatgccaatggaggaggaaccagacgacctgtagccggatcaacgtggcactgttccggtttgaacttgtaagcaccgtgagaagtaccgattgagatagccaatgaatcgcaacctgtacgagtagcgaagtcgattacttcttcagggttagtataagtgtggtgttctgcgcaaacttcgtcttctacaccagccaatacaccaagttcaccttcaactgttacgtcgaactgatgagcatagtcaactactttcttagtcaaagcaacgttttcttcgtaaggcaggtgagaaccatcgatcataactgaagagaatcccatgtcgatgcaagatttgcagagttcgaaagaatctccgtgatcgaggtgcaatacgatttcaggatgagcgcagcccaattccttagcatattctacagcaccttctgccatgtaacgcagcaaagtctggtttgcatagttacgagcacctttagatacctgaagaataaccggagattttgtttctacagctgctttgacgatagcctgcaactgttccatattattgaagttgaatgcagggatagcgtatccacctttgattgctctagcaaacatatctctagtgtttaccaggcctaaatctttgtaattaaccattgttgtaaaatttataattgttagtgattaaattccgtatgcaaatttaagaagaaatgttacaactctttccctccaccgataaaaaagttttttatctatacacattttgacataaatcatttctgttttacctaaaaaagccttagtatgtaaagtgtatattacaaatataagcaccttgtttcacacattttatcacctgaaacgagccccctcctacgacttcatttgccggacaaatcaactttttacaccttataatatacacatgccggaatatccttgtccgaagtcctgttcttttgccgcatccggcaagactttatataaaaaattgcacaaatcattttctatttcaaagaaaagcagtatctttgcaacccgaaacagaccattacacacttattttgcagtgttaccactatagcaaataataacaataaaagtatatactgaaatgaaaaaaggcattcatcctgaaaactaccgtccggtagtatttaaagacatgtcaaacggtgacatgttcttgtcacgttcaacttgtgcaactaaagacacagtagaattcgaaggcgaaacttatccttgtgttaagctggaaatttctagcagctctcacccgttctacacaggtaagtctaaattggtagacactgcaggacgtgttgataagttcatgagccgttacaaccgtatcaagaagtaatcattacttgcagaaatataaaatcgggcgtttctttcacgtgggaaacgcccgattttatttcgtcccctttcccccttcctttccagcatccgctcaggatattctgccgcccgcaacagacagcacctcttttccaccttttattcacctccgccttttatcgctccggcacagtcttgcctgcaaggcgcatccgttccgtaatttcttccggacttttactctacacctcctgaaaacggcagaaaaacgtcgagaggttttccgaaaatttgtacaaaaaaatttcttttttgtacaaaaaagaaaggcattgccacgagatgtatcacaccttcccggcaatgcctcagcaatatcagcaggaactttctagaaagtcttacttggctgtgtctttttcacgtatttctacacggcgaatctttccactaatcgttttgggaagctcatccacaaactcgatgacacgcggatacttgtaaggagccgtaacacgctttacatgatcctgcaattccttcaccagttccggaccagctttcggcttgtattctttcgacaatacgatagtggcttttaccacctgaccacgtatctcatcgggcacaccggtaatggcgcactcaaccactgccggatgggtcatcagggcactttccacttcgaacgggccgatacggtatcccgagctcttgatcacgtcatcggcacgacctacaaaccagtagtatccatcctcgtcgcgccatgctacatcgcctgtatagtaaacaccgtcgtgccatgcctcatgcgtcagttccggatcgcgataatactccttaaacagtcccagcggctttcccttatcagtgcggacaacgatctgtccctgttcaccgtcctcggccgaacgaccgtcgggtgtcagcaggtcgatgtcgtactgcggattaggcactcccatgctgcccggcttcggatccatccacgggaaagtagcaagcgtaagtgccgtttccgtctgtccgaacccttccatgagccggatacccgtaattttcttgaaggtttcgtaaaccgaatagttcaaagcctctccggccgtcgtgcaatattccaaagacgacaggtcgaacttgctcaagtcctcacgaatcaggaaacggtagatggtaggaggcgcacacaacgaagtgatatgatattcgtgaatcttctgcaaaatatcagcaggagtaaacttctcatggtcgtatacaaaaacattggcaccggcaatcatctgaccgtacaattttccccacacggcttttccccagcccgtatcggcaatggtcaggtgaagactgtcttcgtgcaggttatgccagaagcatccggtggcaatatgtcccagcggataggtaaaatcgtgtgccaccatcttaggttcacctgtcgttcccgaagtgaaatacatcagcataatgtcatcgttggtattcacatgttccggacgcacaaaaggagcagcgttttcaatgcccttatggaagtcctcgaaaccttccggatactccggtcctacgctgacgagcttctccacactcggagattcgggcatggcatcgagtatatgcttggtgatgacttcctcacccgcagccacaatcatcttgatggtagcagcctgacagcgataaacgatatctttcttcgtgagcagatgcgtagctggaatgactatcgcaccgattttatgcaatgccaaaatagaaaaccaaaattcatagcggcgtttcagaatcagcatcaccttatcaccatgtccaatgccgaggctctggaaataagaagccgtcatgtcggtatactttttcaggtcggcatacgtaaactgaatatgatctcctttatcgtttgtccagagcaatgcattcttttccggacgttcggctgcccaggcgtccactacgtcgtaggcaaaattaaagttctcgggaacctttatcttgaagtgctttataaaatcctcctgagaggtaaaacttgtttgatctaaaaatcgttctaacatatattttatcgattgtttttactcgtttatttgtattgttcatggtatgacgaccgccagaaatttcacggtctttccgtctagtgccagcatgccatgcggcttgcttgaatcgaaataaaggctgtcacctggattcagaatcagttcttttccgttgatgttcagtagcatgcgtccttcaattaccagattaaactcctgtcctccgtgtgtattgaaatataccggcgtgtcttccggcttcggctctaccgtaacgataaacggatcagccttgcgccccttgaaaccagaagcaagcgactggtacttatatgccttggttcgctctacggaaacccccgttccccggcgagtaagaaaataagatttcattttgggttcttcaccaaacatcagttcatccagcgtaatgccgtattcacgagctatccgctgcaacacgcttacagagaagtcacattcacccgactcaagggcctgatattcctccaccgtaaagttacagtcggcagccactttctccatactcaaatctaaagcgtcgcgcaaacctttcaagcgttcggctatctgcctaatttgttcatccatattaatatgtcttttaagataatgatttcagattaatcaaggtacaagtaatcgtaatgcaccagtggacgctgaccgtgcatgcccagcatctcccgtgcctcgacggaatcgactccgatgcgtcctactcctatctggcgtccccgtgcatccatgatttttacaatgtcgtctttttcaaactctccttcgatggcagtaactcctaccggaaggatactgacggctttctttccttttacagcctttaccgccagttcgttcaggtgcagttcgcctttggcaaacccttcgctgtgggcaatccatttctttacactcgacacgacttcggaagaaggaacgaaacgggtacagactgtctcagcgggatgctgcaacaaatcgagcaggatgttttccttttttccgttggctatgatgacggtaataccttcgtcggccaccttccgggcaatggtagtcttggtaagcatgcctcctctgccgaaaccggacttctcggtctggatatagtcggacaaatcttttccgtgttccacctcacgtatcaccgacgtacccggctgagaaggcgaaccgttgtaaatgccgtcgatgttactcaggataatcagagcctgaacatcgagcatcgaagcaatcatacccgacagttcgtcattgtcagtaaacatcagttcggtaacggatatggtatcgttttcgtttacgatagggatgactccggtttccagcatcacccgcatacagttacgctggttcagataatgacggcgggtagcaaaactttccttggttgtcagcacctgccctacggcaatgccgtgttcgcgaaacaattcatagtaccggttaatcaactttgcctgtcccacagccgaatacaactgacgctgtgccacgctgtcgagtttccgcgacaccttgatctcgctgcgtcccgaagcgaccgctcccgaagaaatcaatatcacctccactcctgccttgtgcagctcggctatctggtcaaccaaggccgacacacgagttacgtccaacgtcccgtcacgacgggtaagtacattgcttcctacctttaccgctatctttgtaaactgaaatgccataataactgttcatttttttcgtatggcaaatataactttttacttcgtaaagcaagcgaacagcatgaataaaatataaaattgttacttattgatacacatcaatccacatttatgggaaaatcagtacctttgcctgacaaaattcaacaccttattatatatggtcaaagctatcttcttcgacatcgacggaacactggtttccttccagacacataccattcctcagtctacacaaaacgcgctgaaactactgcgcgaaaaaggcatcaaggtatttatcgccacaggtcgccccaaggtattaatgatggaagcggtaggacacctgccattcgacgggttcatcaccctgaacggcgcacactgtttcacctctgcccagcaggacatctataagggaaacattccggaagacgacatcgaacgcctcatcggctatcaccaccagcatccggaaacgcctttcgtttttgtgcacgacaatgaatggttcataaccggcgtaaacgaggcggtaaaagaagtagcccagctcatcgagatcgaaatacctcccgtacgtcccatcgaagaggcacgcggcaaggaaatcttgcagatcatgggttactttaaggaagacgatgagctggaggtgttccgcaaggttctgactcactgcgaaccgatgcgctggtatccgctctttgccgatatcattgcacgcggcaacagcaagagcaagggcatcgatcaagtactggcttactacggcatcgacctgaaggatacaatggctttcggcgacggagggaacgatattcccatgctgagccatgtaggactgggagtagccatgggaaatgctgctccagaagtacaagctgccgcccgttacgtaacgacctcagtcgatgaagacggcatcatgaatgccttgaagcatttcaatatcttataacatcaatccagccacagctttgccagataatcgtagtggtcgccttccgctacgatttcggcatgaaatccgtattgcgaaacataggcggaaagtgtatcgaaatcgacatacagccagtcgaacgaatctccttttatctgtttgtactgcatctggaaatcgacttctccgtaataatccgcagccagatcgagcacataactgccgtcctcgtcttcatacaggtaacgcaaatcgctggagtcaagcaatatgcaccctccgggagcaagcagctgcttcatcctcagacagaaatcgggcatgttcttcagcttaccgataatgcccgaaccgttcatcagcatcagaatggtatcaaactgtccggtaaagtgttcatcgaaaacgttggcctgcaaagccttcacaccccgttcttgcatggccttgaccgacagcggcgatatatcgatagccaaactttccttacctatttccttgagagccagcgaatggcagccgcttcccgcacccacatccagaatccgaccctttgccaactgcaaggcaacctgttcctgacggggcatatccttgtatgcacgaaacaattccgttacgggaatctcgtcttcatcgaactgcgaagaaaaaactctcaggcgcccagccttgccatgtttgaggaaatcgtaaatagccgcccccatcggatctttctcttcagacaacaaatttatattcataactgtaaatgattcattattttacacacctgcaaagatacaaaaagaggttcagactgcataacgatgactatttattcacgaaatttgcataaattaagaataaaacaagaaaaaagcaggttgttctgtatattatttcaatattatctgtatatttgcagcctattaaagaataattatacacaatgaaaagtaaaaacagccgacttgattccattaagatgattatctcaagcaaggagataggaagccaggaagaacttcttcaggaactgtcaaaggaaggttttcaactgacacaagcaactctttcacgcgacttaaaacaactgaaagtggcaaaagctgccagcatgaacggaaattatgtatatgtattgcccaacaataccatgtacaaacgcatgaccgagccacatacagcctctgagatgctccgccaaccggggtttctgtctattgaattctccgaaaacattgcagtcatcaagacacggccgggatatgctagcagcctggcgtacgacatcgacaacaaccatttccacgaaatcatcggaacgattgcaggcgatgatacgattatgcttatcgtccgcgaaggctgtacccgcaccagcgtaaaacaagcactggcacatgtaataccgaatataaacctaataaaataagatacagaaagaaaatggatactaaacaaattgatgttatggtagccgacgcctcacacgaggtatacgttgacacaatactagatacaatccgtgaagctgccaaagtgcgtggaacaggtatcgcagaacgtacacacgaatatgtagcaacaaagatgaaggaaggtaaggccatcatcgctttgtgcggcaacgaatttgcaggattcacttacatcgaatcatgggggaacaaacaatatgtagccacttcgggacttatcgtacatcctaaataccgcggatgcggacttgccaaacgtatcaagcatgcttcgttcacgctggcacgtctgcgctggccgaaagccaagattttcagtctgacttcgggagctgccgttatgaaaatgaatacggaactgggatatgtacctgtcactttcaatgaactgaccgacgatgaagcgttctggaaaggatgtgaaggctgcatcaaccacgaaattctggttgcaaaaaaacgtaaattctgtatctgtacagccatgctatacgatccagcattgcacacagacgacaaaataacaaacttttaacacaacactcaatcaacaagaatattaatacagaaaaagatgcctcattttcagccatcgtttttcactaaataaatgccttatggaagaaaagaaaaaagtagtcgttgcgttcagcggcggactggatacatcattcacagtcatgtatctggcaaaggaaaaaggttatgaagtttatgcggcttgcgccaatacaggtggattcagccctgaacaactgaaaaagaacgaagaaaacgcctacaagctgggagccgtgaaatatgttacactcgacgttactcaggaatattatgccaagagtttgaaatacatgattttcggaaatgtattgcgtaacggtacttatcctatttctgtaagctcggaacgtatcttccaggcacttgccatcgcacgttacgccaatgaaatcggagctcatgccatcgctcatggttcaacaggtgcaggaaacgaccaggttcgcttcgatatgactttcctggttatggctccgggagttgaaatcattacacttacccgcgatatggcactgagccgtgactatgaaatcaattacctgaaagagcatggttttgaggctgactttaccaaactgaaatattcatataatgtaggtatatggggaacatctatctgcggaggtgaaattctggattctacgcagggattgccggaaagtgcttacctgaaacaggttaccaagactggcagcgaacaactcaagcttgaattcaagaagggagaactgtatgcggtaaacggcgaagtgttcgacgacaagattaaggccatccagaaagtggaagaaattggtgcagcatacggtatcggacgtgatatgcacgtaggtgataccatcatcggtatcaagggacgtgtaggcttcgaagctgcggctcctatgctgattatcggtgcacacagattcctcgaaaaatatacgttgagcaaatggcagcagtactggaaggaccaggtagccaactggtacggtatgttccttcacgaaagccagtacctagaaccggtaatgcgtgatatcgaagccatgcttcaggaatcacagcgtaacgtaaacggtacggctatcctcgaacttcgcccgtattgcttctctaccgtaggtgtcgattccaaagacgacctggtaaagaacaagttcggcgaatacggagaaatgcagaaaggatggactgcagaagatgccaaaggcttcatcaaggtactctctactccgctgcgcgcttattatgcaaaccataaagacgaggagaatatctgattatgtctagtaaccaaaagctcagacgtccacgcacgggaagaatgataagcggagtatgtgccggattggcaaacttcttcggtcttgatgtatctatcatccgcatcgtgtacgtgatactgactttttttactgcatttgcaggtatacctatttatatattaatgtggatcattattccacaagaaaacaaccattattttcatgattaaagtaggaattataggaggggctggatatacggcaggcgaactgattcgcctgctcatcaaccaccccgatgtagaaataaaattcataaacagttccagcaacgccggcaataagattaccgacgtgcacgaaggattgtatggcgaaacagatctggtatttaccgacgaactgccactcgatacggtagacgtgatattcttctgtacagcacacggtgacaccaagaaattcatggaaagccataccatccctgagaatgtgaaaatcatcgatctctcgatggattatcgtatcaaggatgaaagtcatgatttcgtatacggacttcctgagctgaaccgccggactatctgccagagcaagcatgttgccaatccgggatgtttcgccacctgtatccaactgggtctgctgccgctggcaaaacatctgatgctgaacgatgatgtcatggtaaatgccatcaccggaagtacgggtgccggagtcaaaccgagagctaccacacattttagctggcgcaacaataacatgagtgtctacaaaccgtttgcgcatcagcatgttccggaaatcaagcaatccctcaaacagcttcagaacagcttcaactcggagattgatttcattccgtaccgtggcgacttcgcacgaggcatttttgctaccattgtggtaaaaacaaaagtggaactggaggaaatcgtaaagatatacaaagagtattatgcagaagattccttcacacacattgtagaaaaaaatatcgacctgaagcaagtggtcaataccaacaagtgtcttatccacctggaaaagcacggcgacaaactgctcatcatttcctgtatcgacaacctgctgaaaggtgcaagcggacaggcagtacataacatgaacctgatgtttaatttggaagaaaccacagggctgatgttgaagcctagtgccttctaaatcatctaaactctttttacaaaccatgaaactattcgacgtatatcccttgttcgacgtaaacatcgtacaaggaaaaggttgccacgtatgggacgataagggccaggaatacctcgacctttacggaggacatgccgtcatctcaatcggacatgctcacccgcattacgtagatgcaatcagcaagcaagtagccaaactgggattctattcgaactcagttatcaataaattacagcaggaagttgccgaccgtctgggtgcaatgtgcggatacgacgattaccagctcttcctcatcaactcaggtgccgaagccaatgagaatgctctgaaactggcttcattttataatggacgcacccgtgtcatttcttttgccaaagctttccatggacgtacatcactggctgtagaggtaacaaacaacccgaaaattatcgctcctatcaacgacaacggacatgtaacttatcttccgctgaacgacacggaagccatgaaagctgaacttgccaaaggcgatgtatgtgcggtcatcattgaaggtattcagggagtaggcggcatccagttgcctaccagtgagttcttgcaggcattacgtcaggcttgcgacgaaaacaataccgtactggtactcgacgaaatccagtcgggatacggacgaagcggaaagttcttcgcacaccagtatgccggcatacgtcccgatctcattactgtagccaaaggcatcggcaacggtttcccgatggcaggcgtgctgatcagccctaaatttactccggtatacgggcagctgggcactacattcggaggtaaccatcttgcctgtgcagctgcaattgccgtcctcgatgtaatgaaagaagagaacctggtagaaaacgctgcgcttgtaggtagtcacctgatagaagaactgaaaaaattcccgcaaatcaaagaagtacgcggactgggactgatgatcggaatggaatttgccgaaccaatcaaagaactgcgtaaacgtttgctgttcgaacaaaaggtatttacaggcgtaagtggtaccaatgtcattcgcctgcttcctccgctctgcctgagcatggctgaagccgatgaattcctgaatcgcctgaacaatgttctgagcaaataaaacgatactctcgtccacttcaaatagccatatcacgctcgttgcaagcttgatatggctatttttttatccactactcacctcataaaggtgtgaacaacacataaaaaaacgtcatattccactcaccaacggagttcaatatgacgctttatccggaagtcaataagatttatccaagcaaatatttttctatattaagaacatctcaatacctgaccgatacgcagtgtagtagtacgcttgataccgtttatctgacacaagcggtcgatagaaacatgatacaaacgagagatacgtcccaatgtatcacccttgcgtatcttatggtaacggatagcagatttctcagcctcatcagcacccgatttgccactctttacagcagccagagcacgtgtacgctgataagaataacggttagcaccacgaacaaacaagtaactatccgaaacgatatcttgtttagggaaatcgaacatgaattcagggttgataacttcacccaggaaacgggtttcgaagtgcagatgtgaaccagtagaacgtccggtattacctcccagtccaatcgggtcgccggcctttacatattcattctctttgacaatctgttttgagaggtgaccataaatggtttccagtccgttatcgtgacgtattacaacgtatttaccatagccacggcgttcatactttaccatacgtacctttccgtcgaaagcggcacgaatcgtatcgccgatatataccttaatatcaagtccgttgtgcatacgacgccaacgcggaccgcacttagaagtaataatagtatgggttgtcggcatacagaagcccgtcaggtcaatacggaaactgtcaggaacctgtacggtattaccgtaagcgtgaacacgctcgttattccagttggggtaaagactataagcaggataaactgcttgttctgctttaatctggcgaatcaacgccaaagaatctactgctttcagttttctgtcgataggagcctggcgagccaacaaatcttgtcctgctacatttacactgactaaagccaaggctgctactgcaactgttctaatacattttaaaatcattatatttatactatttttcagcctgtacctgcaagtgctctcctaactctctatccgcttcttgcgctggtacaactgccggttcaaaacaattctacatgaaatatgtctttttcagacattaaggtttcaaaaaatcgtttcaaatatagcattttctcagcaaaaaacagagtacagttaactattttttatgtattttcataccagaagcatacgctcttttcaaatacatgttattaaacatataaagctcagaaacaatatacaataatttacaactttatattgctgctagtatgataaacttttcagaaagccgaacatgaatcaaagacatacgaagcgcccttcccgccagatatacttcaagggctctgctacaaggtatggctttatttcttccgccgtttccttatccagataatcgggagtagtatacgtaaatgatagagtggtatccgtttccgacaaattggccttgagcagaaacatatcggcccttacacgcagattctgcaaggaatcagcctgtgattccgaagcaggagtcttataaaaggcattctctacgggcaaagtcagaaatttatcagcagaaagttgtttccacgatgtgtcataaaaagaaatacggctgtcgcttgccggtcctttaaaagtatgtaccacacatatcacttttactgaatcatttaacggaagcaatttcatttctaccgtactgacctcacttagcctcaactccaagtagtcatccgtcagtttcagcatttccgatgtatttcctaaacggtttttcacttctgccttcatgttacttgccagaaaatctccaaaatcggctctattcaccttcgtcaacaagggcgaaagagaatcgggaagagcgacaaacagcgatttcatatcttgcgccttcatgcccgtacagcaaagcaatactccgatgacaaacaatattttcttcatgggatattctattttttatgcaaacctgaagctatcataagaaagctcattgcctgcaaaagtagtacattcacggcatatttgaaataaatagcccgctttttatttctaccgtaaagagcattaccagaaagtgtagtaccaaatccagaaaataaaaaaactgctcagattacactccaagcagtccttagtatgtcatcaatatacaatcttacgttctatctcctcaaaacgagggaacagcagattgttctccaagtgaatgtgttcaaacaaagcatccacgaacgcttctagctcctgcatcatcagacgatagctggcacaaccgtcctgtggaaccgagaaatgatctgtcagctcaatgatatgtaaataacggttaccttctccttcatgttccatcttcatcacgcgaatcggattggcaattgtaccacaatgcataggctccatacgctgtccttgttcgaatgccgcatacaaatcgtacaaataagggaacaatacgttttcctctttctgcaagtgcatttccaaatcttgaagcgattcactgaccaaagctctcaattcatgcaactcgggatgtgcttcaccatgtacccgctctactttctccagcaactccatcagttccggtccccgtgaacgaattccacgatgatgtattttcaatatataatccatcagcaggtcgagaggccacgaggcaaaaggaatacgacctccgccatcggtttcctgacgctccaaagcctgcatcacttcttccagttccagtccctgagcagcacatgccgcatccagcgccacttctccgtgacagcaaaaatcgataccatattttttgaacactttagccgcagcaaaatcttcagcaacaatatttcctacacttgtatgtttccagtctgttgttttcattttccctgttattttgattacggatgcaaaggtatacttccacctacagaatctttgtcacctatgtgacaaagacctataatgaaagttaaacagcacaggataatgattcaacaggggaaagttccgttccatcctcgcagagattacagcaaaaaacgtcagcacatttttcaaaaatatgctgacgttttctattattcatcggcgggaattatccctttcgcttcagaaaatcggtcggactttcaccaaaataatccttgtaacatttggtaaagtacgaaggagagctaaaaccgacctcatacgttatttcggcaacggtcttttctgtagacgcaagcaacgacgcagccttctttaaacgagctatacgaagcaactcattaggagagtaacccgtcagcgccttggctttccggtacaactgtacacgactcataccaatcttgtcgcccaaatcttccacgctcagttctgaattgcccaactgttcttctatcagcgtacgaagtttctcgacaaagcctttatccaaatcagcaatcggctccttgcgtaatgaagtcttgtcggcaaagaaactttgcagacggcgacggttgtctatcaaattacgtaaacggaccaacagcaagcgcgcactgaacggcttcaaaatgtatgaatcggctccacattcatagcccatcactttctgctcatccatggtataagcagtaagcatcatgaccggaatgtgtgaagtctgcacttccgacttcaaccgccgacagcattccataccatccattaccggcatcattacatcacaaataaccacatcgggtacatatttcatagcctgctggataccttcctgcccgttagaggcctcaattaccgtatattttccgtaaagaagagctttcacgtaatcacgtacatccacgttatcgtcgataaccaataccgtttccttatcatcacgttccacaagctcaggcgctgtctgtatggtttcctgatcggcagacaccagagctccttctttcaagttcttcaagattatatttttttcgacatgctcttcaggtactccctgctgttgcatcggcatttcaatagtaaatacagcacctttccccttatggctatccaccgaaattgtacctccatgcatttccacaaaagcttttaccaatgccagtccgataccggaacctgcatgatggacatctatctgataaaagctctcaaaaatatgctgcacatgttctgccgacatgccgattcccgtatcggatacctgataacgtaaccagcaagcaccatctttattgaattgtgaaagcttaactccaattgatccgttctctggagtaaatttaaacgcattcgaaagcaggttgtatgtgatacgttccattttctctgcatcggctatcattacatatccctcttctgaaggatcggccaaaaccgtaaaatgaatatgcttgcgataagaaagcgtacggaacgcttcggtccagtctttaatttgctcccaaatatcgaaacgtgacagtgtcatatccaactttccgttctcgaacttgcggaagtcaagaatctgattgataagacgtaacaagactgttacatttttctgtacgatattcagaaggaaacgctcgttctcaccgagattattactttccactaattggttcacaggatcggctatcaaggtaagcggcgtacggaaatcgtgtgatacattcgtaaaaaaagccaatttggcatgtgtcgcttcttctagttgctgcgaaaggctgattaactggtcacgttgttcctcaagacgtttcttctggtcggacagttcttcattcaaccggtttttagtccaaaacgcccgcaccacaaagaaaagtaacatggctaccaatatcagaatgacgatacaagcatacaggagcatccgttgtgaagaataacgcatcagataagtatccaactgtttatcaagtacctctatcttagtatccagttgactgatatgggcagtctgcatctgcatgatacgagcatttgccttattgaccagcgcagtcgacagacttgtctcacgagcataatccttaccacgcaatatattcatagcaacttccatcaccttatcaccaccggtagggtaaatgaacgtagcatccaaatgtccatcggccacctgttctaccccatagccttcacctgccagtgcatcaatcccgacaaataacatatcgtgttgacgatgtcgtttgaccgcagtattatatgcaccaatagccatgcggtcgttatgcgcaaaaaccatatcaatatgaggataacgggaaagaatagaatcgaaagcgacttctgcagattccttaagccatgctgcatcggccgaagcgataatcttgatacccggagttgccttcagcgcatccttcaatcctctatgacgttccaatgccgacgtagagccacgcaatccggtaacttcaaccagattgccttcaccttgcagacgctcggcaacataacgccctacatgacgacctatttcataattgtctgcccctacataggcagtatacttatccgaatgaattttacgatcgactagcactaccggaatacctttatcgtatgctttttcaatgacaggagtaatagcatcggcttcattgggagaaacgataagcaaatccactccttcgcggataaacgattctatgtcagcaatctgacgagtattattgtcctttgctgtaagaatttccaccttcactcccggatagaacaaagcttcacgacagatttccttattcatttgttcgcgccattcatcgtcactacattgtgatactccaatcacataacgtacctcccgaggagcacatcccacaaccaaccagcaaaataacgaaataagggcaaacaaagaatgtctcatagtataaaattgtgtgttataataaatggataaaccttcacacgttttgccattgcctcccggcaacaaaacgtgtgaaggaataaaaggagaaaaaggcttattttacaacgcgatctttcaaagattgcggcaaaacaggcattgctccattttgcgtacaaacataagctgaggtttcaacagccagcttatgtgcctcgccaatagacagaccacttaagatagaagcgacaaacgcagccgtaaatgaatcaccggctcctaccgtatcggcaacttccactttcggtgtttcaacaaaagaaacttcacctggtgtaaagacatagcttccgtttactccacaagtgagaatcaacatcttcaagttatacttagccagcagaatccagcatttatcctgaagatcaattcccggatagccaaacatacggcttacagtaaccagttcttcatcatttatcttcaacacattacattttctaaaagaattgcagagaatttctttggtatagaatccctgacgaagattaatatcgaaaatcttcaatgtattttcggctggcatcgtatcgaggaaacgattaattgtttcgcgagagacaacgcttctctgcgccagtgagccaaaacatacggctgtagtgtgtttcgccaaatcttccaatgccggagtataaggaatgttatcccatgctacaccttcttttatatcataacatggcactccctcattatcaagttctacctgtaccgtaccagtaggataaggtactatctctaccattgtatttaacttcttctcacggaaattatccaaaatctccatacccagcttatcgtcacccacagcgctgacaacgcggctgttcaatccaaactgtgatacatgataagcaaagtttgcaggagcaccacctattttctttccttctggaagcacatcccataatgcttcacccattcctacgacaatcgtattttccatatctagtttcttttattaaagttaaacattactttttaattttcaatgtatagaacagcaaatatattactccaaccgtcataacggcaactgctccattctgtccgatagcatcacttgcaaaacccataaacaaggggaataccgtaccaccgaacaatcccataatcattaatcccgaaatctcgttcttcttttccggaacggcaagtaatgcttgtgaaaaaatgatagagaaaatattagagttaccgaaaccaatcaatgctatggcaatataaatcactgcaccggcatcggaagcgaagagcccgatcatagccagcaacatacaaataacactgacgataaagaatgaacgtgaagatactttctgcaagataatagctccggagaagcatcccaaggtacggaatataaaatacaagctggttgcaaagcctgcctcatcgagtgtcattcccagacgttccatcaaaattttaggagcagtagtattcgtaccgacatcaatacctacgtgacacataatacccaagaaacagagcaagataaacggacgtcccagtaacttcaaacaacttacgaaaccggaagccttatcaggcttttcttcttctataggagtagctcccaaccacagaacagcaatcacggctattaccatatatactgggaacaatacacgccagcccagtccaaatgtaggcattgcctgagtggctccccacatggctatatacggagccaggaaagaagctatcgccttgacaaattgtccaaaagtcaaagaactagcaagtttatcgcccgaaataatattactcaacagcggattcagcgaagtctgcatcagtgcatttccaattcccagcaacgagaacgagcacagcattaccccgtagctatcactgaaaataggaataagaagtgacacaaatgtgacaatcaagctgagcatcacagtctttttccgtccgattctgttcatcaggatacctgtcggtacagagaaaatcaagaaccagaaaaagactaatgacggaaaaatattagcttccgaatcactcagattcaaatcggcttttacataatttgatgcgattcctaccaaatcgacaaatcccattgcaaaaaagcaaagcatgataggaaccaattttgcatatttcagtttatcggttgttgtcattttaagtaaagctttatagtaaatgaatgttttttattacggtccggataaaataactccctttcctcaaaaaggatttaaggtcaacaagtataaaaggccgagccgttggatcatagcaggaactaaaagcaccgttgtgcttatagtcccaatttatatattttcatgttgctgatctgtgcttcaccattctcagcatagaagttcattgcattgtatggttgagttgggaataccaaatttgtcatagcaatgcgtccaccatcaacaaagatttcgacagaacatttatctacaaaaatattcagatgataagtctttccttcacacagtgacagaggagcccatgtacccagtgcaaaatcattcttgtagttgacagacattgtcttgcggtgatcatctgtttccttggcatttacatcaaatggaccaattttctccagatcaacaaatccactttccgtacggtcggcaatcagtttacctgccttcatgtcaagatagattttcattttttcacctttcgcattcagcagatcaaatcctaccatctgtgccttacccggagttacatccatctccagttcataagcaccgtctgtattcggaacgatttcgtcaatcttgtactctccctttacagtaaaatcgtcgaccttacgtgtatccttacgcaatgcttctgtttccttcacagcattggcagccatatagatttgtccgtcttttgtataaagcgacaattcacgaggcaatgcgttggcaccgcgatactgcttaataggagtgatattagcatactgccagttactcatccaaggtacagcaataatacggtcaccggtgttagagaaacatacagttgcataatggtcttttccataatccagccatttggttacttcgggcttagtatcacatttaaactctttaccatcgaaatcaccaacgaaatattctgtagcactaccaccgaacatacatcccgggttaatattgacaatcatgacccatttcatgttgttcttgtcgccatcaaccggaagctggataaagtccggacattcgaactggttaggctgtactccataaccttttccgaagccacttaaatattcccagtctttcagattagaagaagcatagaagcgcatttctttgtcagcagaaacaatcatgtaccacttctgagccggttcataccagaataccttcggatcacggaaatccttcaagccgtcgaatggagtcagaaccggatttttctcgtattttgtatatgtacgtccgttgtcgttactgtatgccatgcactgaatctgtccgtgttcatcactcgcagaagtataaaaagcaatcatggcatccttaccgtagcctgcgctgttgttatggtctacaatagagctacccgaaaaaatatgtcccagcgtatcgcgagcaatagccggcttcaagtgctcccaatgaatcaggtctttacttactgaatgtccccagtgcatatttccccacttagaaccgtaagggttatactggaaatacaaatgatattcgccatccttatataccagtccatttgcatcattcatccatccatacagaggagtatgatgataaataggacgatagtaatcggtattggcagtattaaaagtatccgataactggatattttcccaacatacagccttagctggtactttgccgactgtaaccgttgcttcttctgttccttgtggcaattcaaacggaacataatattctacactatctacagccagacgaatgtccattgcgacatctgccggacttccagtgtcgagtttcacctttccctcccctgctgtttcctgaacaggaagcaacaaatacttcacgggatgagcaatgtgaatgacagtcaaagaatcgccctgattttcgaatgtcaggccattcttttgcgactgacaagctatcatgctacacaaaaaagcttgtcccaaaatcagctgaaagattttacttttcatggtatatattttaaaatgttttaaagttacaacttttttattttctaataatgaagacctgatatttttatataatctaatacctattgaaaactatataaagaacgtttttcattcttcatcttcatctctttcgaaatgaagatgaagttatatgaatcagaattttatctgagcagagaattctaccgtgaacggacggatataactaccggccatcactgtattggcgtactgtcctgcttcgtctttggtaacaagttctgcaccggcaatactacctttagcacctgtttgattcaggaagttgacaaccgaacatcccagtgacaactttttgttcacctgccaatttaaacctccgaaagtttcccagcgtccattaaagtaatatgcatcattgatgttcgcataagtcttactgaaataacggaagctagtccatattttcaaatccttggtaatcatgtagctcggatcaatttccacaatcacctgcggaatttctgctacaatgtttcccgtcgcattgatctgaccaacatatccgtctgagaacttaaccgaagtttcgtatttcttataagtcggcttctgataagtgaacaagaaatgcaaatcaaatcccttgaacggagtggctactacgtcggtagtccatcccaaagtcttgatatcataattaagcggagctgccaaaatctcattcaccccatttatcgcatgctgaagattcaacgtcgagttattgttagtcttcgagatatacgagaacaatgaagtcaagctcaaccattcattattaaaatagatacctgcacgtcccaatggtacagaaatcttatcggtatttggcaaaacagacggagcaaagttctctatcttaggatgctgtgtaatatatgtaaaatcgccggtaaaaccaaacttatcagtcagcttataagtagcagcagcacttaatgcataattgaaccagtcgtaattaataggagtaggactaatcgctactgcaccagaagtacccgctgtgccagcagcatatcctgtctgattaccatctgcatcatataccggaacagcagtcgctccaaggtaataattagcaaaacgtccgacataatctccattagcattttttacagctgcattgttgccacgaagtgcctgatattccaaacgagctccataatacaagttgaatttttcagtaatatcccagtcgtgagtaaaataaatagctaatttattttcatgaccgttataatattctgaagcattcttgttgaaatcataataatacccatttcctgcataagaacggcttgtagcagtcgcaaaagccggattccacaaacgtaccggataacttccatcggcaggaacagactgatcgtacatcgttgtattcgaagcatagtcaatatcataataccactcattcagtcccaaacgccatgttccgttcgacaacttacgtgacagctcggtagtaaacatcaactcatcaataaagccacggttcaaacatgacatacgactttgaacatattctccatcatacggttgcatagagccatcggcagcttcatactgataactgatagagctattggtgcgttgactcaactccatcggagtctggtatacacacgatcccattgcatgatcatatttcatgacaactttccatgccaatccattatcccatttatagtcattcatcaaaacgaactcactacctttattctgtgcagcatcgtaaagatttgttttcttcaattcacctgtacgcatatcccgatacaccatctcattgtctacaggcaaataagatgtggtaccaagagcgaacttaccgaactctttcacactaccatcgcctacataaataaacggcgccgactgagttgcatagttatatacaggatgactgttactataatgatacatcgcagtaaactcaccgcgattattattgtagcgtttggtcaaagcgaacttataaatctgagttctgtcttgaaacggtgtagacttgattttaaatgttcccggatcaaagtcctgataaatacttccactgtaaaaccagtcattagcaatctcaccattcaagttcagtgaaacttcctgcattccgaaatggttagccttatagtctaaagtaccatgaaaccctttttggcctagctgagtaaaagagtttaccgcataaccgatattacctgttgtaatagcagtttctgcgattttcagaagtcctacatgactcaaactagcatcagcacgccacaatgaatttacggtgtgaggatttgtcgcataagtaaccggtataccattctccagaacattcacatcggccgatggaagaccaatctgaatttcacgaggaccgttagcactagcagcattcagcatgacattacgattcccttcttccttggaattaccgtcattatttgatgatttattttcttcctgtgcgtatccattaacacaagccaaagcgagcagcattattgctgcattcatacgattgcaaaactgttttttctcagtcttcatagttattttttaaatatgaaagagtagattctaattcggcgcaaaagtacacaagcattgactctacagatataagaaatgttacatcatatagcaaaattgttacatgaaacaattttagcaaacagcgtaacatttttatctatctgcatataaatcatttataatggcataatataccgaaacttactgcatagggctcatatatcgcgtgacttgaatatattgaccgataccggttttcggtaacctcaggtttagaaaccgccaactcggtatcggtccagtagtcaatacctattgcaacttatatacacttaatgatttcacagtatacccatctttgtccgattcaaggattaacttattataagggactgccggaaatacaagattcgtcatcacaaactttccttcttcgccgaatgcttcaatactagacgagtcgacaaacaaacgcaggtgaatcttatttgtatcctcaacaggagctaccgttacagcagggaaatcacgactaaaatcgacaataccacttgcactccggtccataacaaattgcttacgcaccgtatcgtaatacatggataccttttcgttctggtcatttaccaaagcaagagcaatcttcgatgcaccagcattttcaattgtcatttccaattcataggcacccttattatccttcagcagactggcaacctcatacttatcagttaccttaaaagagggaatttcaactttttccgaacgtgccttctttatttcaggtgaaggagtacttttcaaataaagttcattgtctaccttataaagagtgagatcgcgagctattgtattcgtactacgatactgagtagtaggaacattatttgcatattgccagttactcatccagcctaatgctatacaacgaccggctggagcattactccatgtaacagtagcatagttgtcttttccccagtccatccatttggtcaaagtaggagaatcattgacaaatgtcttaccgtcaaagtgtccaacaaaatattgtgtggcactacctccgaacggtccgcccggattgatgttgcagatgagcacccatttcttttctttcgtaccttcaaccggaacctctaccagatcagggcattcccatacaccaccatgtgcaccttgcatagtgccgaaactgctttctttcttccagtcctttaaattaggagaggaataaatctgtatttcctttcctacagccagcatcatcacccaatgcttacctggagcataccagaatactttcggatcacggaaatcacgttcaggagaagtcagaatcggattatgctcatatttggtaaaagtcttaccattatccaaactgtatgccatactttgagattgtacatctccccacggacttggtttagctgacgtatagaatgcaatgacggcacctttaccgaaaccggcagtattatctttatcaaccacacaagatccactgaaaatagtaccccatgcatcagctacgatcggagtaccttcatccgtccaatgtaccaaatcagtacttgtagaatgtccccatgtcatatttccccacattgatccataaggattatattggaaatacaagtgatagactccatccttgtagaacataccgttcggatcattcatccagccatataccggagtatgatgataaacgggacggaatttctcacgattggcagaatcgaaagtatcagaaacctttatttccttccagcacaacgaagaagaaggcatacccgtaatgtcgattgaaatagtctttcccgcataggcagacaaatccaatggtacataataatcaactctttcacgagccaggcggacattgatgctctgatctaactgaaactgattattaacaataatgttaaccttgccttctggcgcattctcctgaacgggaagaagtaaaaacctcttcaccgaatccagaacgataatattttgctcgttagccaaatgcttaacattcacattattctctacaccttgagccgtcagtgaaagccctaacataatggccaacaaacctttctttgatgagaataaattcaaatccataaaacaattaatcagtatattaataataacttacttcaacattgcttacctcaacggtaccttcgtagcagttaatagaccagcagttcttctgtgtaccataaatacgatttgtataggcaacgttatcattgatataaacaacgcaaacagaattgtcagtataaacagttacatgatactcattatcggaaggagtattgaacaggtatccgtcaataccattgatgaatcccataccttcttctccctgctcttcaaaattcaattttttcttattgccgttatcttccggattaacaacaatcgaataatatttcttcgaatcggttccacgaaccaatgagaatccaaacttgtcagtcttgtctgtagtctttacagtaaaggaaatcttattagccacattcaagcggttgaataatacgaaagcatttcccgtcaagacataattaccaccgttttcacttaccccgttattgctttttgccataaccttcaacgaagattttgaagtatatttcttgtcgatgccttctacactacccaatgacaaagtaccatcttcgtgctggataatacgatgagcaaccaggttacctgcccattgaggttcattcggatcggctcctacagctgtattgtcattaccttcacgtgtcggacaccatccccagatataacggttagtaccatccgaagcggtctttccggcatagaaagcacgagaatccaaaagaccttcatgatcatccggccatatacctgcatcattagctgtacatgccttcagttcttccagcgtatgtcctttaaaatactgaactttacggatagcaacatgtttttctgaatacaccagataccaccagtcacccatcttaaagacatccggacattcgtagaaacgatcccacatcatagacatgaacactcctttgtgttcccaggacttcaagtcggaagaaacgaattcggccagaacacctttggttccctgctgagtagaaacgatcatatgataaacaccatcgtctcctttaaagacaaacggatcacggaaatcttttgcactatatccatagtcattgccctgcaaatagaaagtcttgcttttggtccaattcttaaagtcggacgaagttgccatcattacgacttccagatttgaagtatgacccgtatagaatgtataatacaatttttcagactcattataaatcgtacttcctgtacctattgcagcatcagcttccgaagcacttccggtaggaatcacctctcccaaagactggtaagaatctacattcttggtacttactccccagataggatgataggttgcttcctggttgggacgaaattcctgcaaatataaaatcttaaaattctgttctaccggatcataaaacggcatcggatcgcctacataacccacatacggtttataataagtagagaactgttcgtctgtcgaagcgaaatacgtcgctgtaccatcccaatccttttgtgtcaatataggatcatcgtcattgcaacttcctaatgacataagggctgctaaagctaaagaatatatcattgttttcataaattacattgttaagttaacgttgtccgataaatgtcctttatcggacaactattattaaatatttattttgactcgcttattaaataattaatagcattctgagtaagtttctctacatttaaatgatactggtcagccgaaacatctaccccagcagaataccagtcatagcatcctgaaccaatacagagaactctacctgacgtctcacttgaaggatactcccatacaactacggcaccatcacctccatagcctaagctaacagcaccatgatttgtttcccatgtggtcaaatcggcataatcttcccaaccaagatgccactgagccgtactgttagtaatgttataccctttgtcacaagtataaatagctggttttccatcaattgttgcagtagatatacctgcataaagcgcatgttctgaattgtttgtgataaagaagctccatggagcagtagttgtttcaccagatgcttctgtacctccccaactgttattaggaacctttccatctttggttacccctaatttagcagcgtagtatgtagcaaaacgagtcaacaataaactacctccattttcatagaattcttttaccttcgaaacagcctgtaccgcacttgcagcatcagcatcaaattttgcctcgttattaattcctccatccacatgcagatgccaccacattactttacaatcactcaagttaactcttcctgtacgaacatcatcgaatgacaaatattgagcattcggaatattcttcaacatccagtttgctgctgctttttcttccggattaagctcgtcaattgaagaagctaaacctacatatacggcacttggagaatcagactgaacaacacttacaacataaacagtagttgcactctgataagtaacagtaaattcaaccggattagtaaagtcaacagcttgtcctgaagccggagatacggttgcgccttcgatcgtttcaatcgtaggtatcagactcgttatatccgcgcttgtcggtattcgtaccacgatagagtgattttcttcatcgataatacctgtatactcattattcaacttgaacgatgtaattctagcctcatcatgctttacagtaacagtataatccaaaaaggcatcaccgtttgtaacctttatcgtttgagggaaagaaaaattgactacatctcccactttcattgaagcttccgcaccatcggaaacttcaattgctgtaactttcatcgcatctgtattataatcaacaggcactcctactacaaccgttttattcgaattatcaataataccctgatattcgtccaacttcaaggttttcaaccaagtatctccactcaattgaagatctgaagcattatcatcacatcccacaataaaaatcaatgagaggaggatgaaaagaactttatttatatgttttattgcattcataatattcatttattaagattcacaatttaattaccaacctccacagttctgtgtataatgtccgttactagcacttatctgagcgaacggtatgggcaagtattcatttttatttttagtaaacgaagcacttgaatagacagcacaattatcagcttcttctgcatagaacttattcaaaacctgatcggcttcaccccaacgtaccagatcgaagaaacgatcacattccattgccaattctacacgacgttcaaacttcaacatcttcaaagcttcatcctttgtgtaagttcctgtataaggtttaacatagaatgtaactccataagtagaaggataatttgcaatcatggttgtactctgacttgcacgattacgcaattcattaatcaagtcaatagcttcaccaatacgtccgtcattcaactggatcaatgcctctgcacgcatcaacaacacatcagcataacgaagaacgatatggttcattgggctaccccaccatccacctttaatcagatatccgctatctggatctacattctgcttcaatgtgacataataaccataaagaccgttactacgactccaagtagaagacttatccatcatgtatttcttattgaactcgtacgggaaccccggcatacctacagtcaggaacaaacgaggatctgcattatcagcagttacatcgtagtcactattattaaaggtatcgaataacggatgtccgtctttatctgttctaaatgcatttaccagattctggcttggtttatagaaatcacaaccgccatctgttacacccggaatattcggaacgatcaaaccatatgaccagttacagttaccattgtttgtaccatcattcatagaatactgcatagcccacaatgattcgcacccgttttcatactgaggctctggacggaagttattatgaaaatccggttccaggccgtaacctccggccgacatgattgatttttctgtatactgaacgacctttgccaaatcttcagcattaatgcttgtcacctcattgttctcaggattgtcctgacgataggccttgtacaaataggtcttagccagataagcagctgctgcagctttggtaggacgacctttatcggcttgtgtatccggcagataatcataagcaaactggaaatcatttgctatctgctgccaactttcatcatttgtataagttgtattcgacaagttattgtattcctctggagaaagactttcatcgtttgccaaaacgatatgcttatataactgcttcagcaagaaatgtccatgtccacgcaagaatctcatttcagcaatacgctggtttttcaatggataagtactttcatccatctgatccaacaactgcaaagcggtattggcacgagaaatacagttatacaaacgctgccacatatcgctgatattccatgcagtagtcatgataccttgagagatatccaacgtatgaaacacatcaccatcctcagtaccatttccacctttataagcatcgtctgaacgaacatcatagttccacatggagaaagaagagttgatatcttctgcagatatccatacagcataagcagaaacgaccagattgtctacatattcagaattctgcaattgttcattatcaatggttccctgtggtacttgatcttccaaaaaatcagaacatccagagcaagccaacgtagcacctaaaatagttgcatataataaatttctcataattttcattttaatagttacttgtttttaaaagctgacattaacaccgaaagtcaagttcaaaggaatcgggtaaccaaaattcgggttttccggatcaactcctgtgaaatctttactcttaatcgtaagtaagttctgtgcacttaaataaaagcgcaaacgttccatttttattttctttaccacgttctctggaacattgtaaccaatctgaagattacgcagtttcaaatatgagccattctctacaaaataagtagatacacgtttttcattattaatatcatcacgcgacaatgccggaatatttgaatcaggatttgttggactccatgcatcaagaacccgtttacctttgttcaagaaaccgatattcaaaccactccacaagtcagtttcctttttcaagtcactaataatatctactccctgtacaccttgccagaataaagttaaatcaaaatttttgtattccagatagatattcaatccatagctgaatgcaggtgtcggatcataaatccactgctggtctttttcattgataacaccgttgccatcaatatcacgccaacggatacgacccaatccagcgccttcctgagtagcatgattatcaatttcagcctgtgacttaaagataccatcggctacataaccaacttgtgctccattcggatgaccaacaacactttctacaccgttaccaccaaatgttccgtttgcagcaactgttgcaggaagagcagtaatcttattacgataagcagaaatattaccactcaaatcatactttaagccaaatgccgtactattacgataacctacgttcaattcaaaacctttattatccattgctccagcattgatccattgtgaactaccttcacccatagcagcaataccagccatctgaacaaggatatcggttgtctttttatagaaccagtcgaatgatccgtacaaagtctgactgaacaaagagaaatcaaaacctaagtttgtctgagtagtagtttcccacttgatatcatcgtttccaatctggttacgtttaaatccagattgcagaatgcttccgccatttgtaccagcgatatcataagaagtaccataactctgtcctcctgattcgcttacaccataattcggaacgtaaatggtgtaacgggcgatatttgagatttcctggttacctgtctgaccccatgaagcacgaattttcaaatcattcagccaagtgagttctttcatgaacttttcgttgctgatacgccatcccaaagatacagacgggaaagtagcataacggttgtttttaccaaaacgagaagaaccatcacgacgaacagttaaagagaacagatatttatcatcgtaagtatagtttaattttccaaagaaagaaaccagagaatatccctctgctgtaccataagcctgggcagttccagttccagcttcaggccacatataatccggagtcaaaatactaaaatcttctttatatccagagaaccagctatcatcttcacggttcaactccataccaaccattacatcaccacgatgtttgcctacttccaaattataagtagccacagcattccacatccattttgtccagtgctcttgctttgcttccactgcatttttatcatttgcaacattaccttctgtaataggatatgtgaagatacgctgctgcttctgagcatagtccaaaccaaaagtagaacgaatattaaaacctttgaagggattcaaattaatatatgcatcaccgaacaaacgccaataagtataacggttatccgaatttctgtccaaacgagctaccgggttctcacggtcaggataaccacctacagggccagcatattctccattgatgtcgtatacaggcaaagacggattaaactgcaacacattttccaagaaaccgcctggggcttgtacttcagaagtacggttcaacgtaaaatgttctccaaccgtcaacaccttgccgatcagattataatcagagttcatacgagcggagaaacgttcgaaatcggtatctttaataatacccaaattcttgtaatatcctaaagagaagaaagaagaacctttttcagaaccattacttactgatacattgtattgctgaataacaccggtacgggttgtttcatcaaaccagtctgtatcagcagatggtacagtattattagaatcaaggaaacgagacatgctaatgccattcaattgaggatagccgttgctatcgtatccccagtcatatttataacccagcgggttcgtattcgggtcctgaccaccatttacataggcctgccacatagcctgaccatattcttttgcattcaatacttccattttattattatacatagaagcagatatagatgcatcaaagtcgatcttcagctgaccatcttttcccttctttgttgtaatgataataacaccattagcagcacgagaaccataaatagaagcagaagcagcatccttcaagacctgaatagattcgatatcattaccattcaattcatgcataccagcttttgtcggcacaccatcgataatataaagagggtcattgttattcaaggtaccgacaccacgaatacggatcgttgttgaaccactcggattaccatctgccgtaacattcatacccggcacacgaccttgcaacgccttcatcggattattttcattctgcttagaaagctcatccacactcactacggaaacggctcctgtcaaatcggctttacgttgtgtagtataaccagtaacaacaacttcatccaatacttcagtatcctcttccaatacaatgtttaatacactttgagcttttacaacctgagttttgaaaccaatataggaaatagctatttccgcattttgtttcactgttaaagaaaatttaccatcaaaatctgtaatcgtaccattagttgtaccttgttcaagaatagttgccccgattacaggctgcccatcagatttggaaactatagttcccgacacttgcaaactttgtgcttgcaccaccgaacacaccaaaataaggagtgttaaaaagaatgctctttttatgctttccatttacacgtagattaagtttaacatataataataaatctcccaaaccgttcaaaacggtactgcaaaattacctgactatacataattcatctataacaaatgtttcattctcgattaaaaatgttacctgaaacatttatactcaaagatgaaacatttgtatcatttaaactacacactgagaaacaatcagttagcgatatacagcacatattaccttttctcctcctacgtaatatacatgaattgccattcgctactcaatttcataagactttagcgctgccatatcgacttcaacctccatcctttaaaagaaacagtggttccagccttcagtgcaaacagttcgatgcccgtttgtgaaacatccggataagtcaggaaagtaaagacatcccttccatcattggcaaataattcaacgctcgaactatctacataaagatgtattcttaatttaccatctaccggaatgactttagcatgttccatccgactgaatttcggtatactcgcatctgtgcaattagtacgatcaattactaaattatgagaatccgtatcatagctgattgtaactttccgaccattcccaacacacaaattcaatccgaacacatttgatttttcaacatcaaaattaagatccaattcataagagttctcagaaggagtaaaaaagtcaaccttatttattcccaccttcaactcctggctacaggttactccgtcataccttaatgtctccaactgcggaaccggtacttgtatcaagcgtaaactttctggatagcttttcaagcccagattccgaggtatagaccagaatcccttaccatacgtactaggcaccagttgagcataatcccaggtagccacccatcccatagaagtgaccgtcgtcaaagttgaatcataatcacggaatgtacgtgaagcgtaataatccattcctttatctacatacagagggtcctgaggatgattttctatcaacttgaattcttttccatcaaaatcacctataaaatactgttcctttgcccaattgacagaaatgaccatcacccattttttgttattccaatctccatcaacaggaagctgaaacaaatccggacattcccacgacttttcctggtcaccacacggcccgaaatcgctctcccatttccaatgtttcaagtcagccgaagaataaatctgtactttcttctcgagtgctttggccacaaccatcacccacctctgagtaggttcataataaaagacagtaggatcacgaaactccgtactaccaatatccagcacaggattacccttataatactgaaaagattttccatcgtggctgaaagacaaaccttgggactgctttttggaaactttttcagcaattgtataaacagctacgcaagcattctttccaaatccggcagtattctgcttgtctacgaccatagatcccgtaaaataattcattgcgatattttctcccgtcatagcaaaaggagtcacttcctcataatgcactaaatcttttgactctacttttccccaccagaacatatgatatttattctgataatggataaacccacaaggatctcctatccatcctttcttgggactgaaatgatactgaggacgatatttttctttataaagcgaatcgacagactgtgcacaaatctgcaggcctatccccagcaaacatcctacgatatacaatgtttttttcatcaccttttttatttgtttttcattagtctgaattttccaaacaaagcgttatcaaaaacacaatctttctaccttaaaaagaacggcaggcttaacccgatcctgccgttacttacaaaaactaacctttattaaaaatcaacatatcctatatttctactatagctagtagtgattcttcaaactaaaactttagcatttatttcattcgaaataccgtcaggagaataacactttcagtcattcactaattttatagtttttcctggatacattaaaaacggaaagaatatcaaaagaatttattttcatgttttccatttacattgtgattcagattcaacacacttaataaattttcccaaaccgctcttaaacggtatcacaaaaataattcttcataaatttaaatacatacaaaaatgtttcatcctcaattaaaaatgttgcatgtaacatttttaattgaggatgaaacattcttctaatcagggaataaccgttccccgcttagctcatccgtatcaaaaggcctctttccgcttcttacttgtcacaatcaaatagattcctaataaaataagaggcagacttaacaattgtccaatatttaacgtcatattcacttcttctgccacctgtggattcttcataaactccaatccaaagcgagatccaaaaaagataatcaaggaaactcctgttatcagcccaatctgcttttgtaaatgaaacttataatacatcagccacgaggtgattaatgcgacaaggcagtacagcatttcatatatctgtgtaggatggcatggctgagctgctccgttctgattataaagttcctgccactcacgggaacgcacaaattcaaatccccatggaagagaagtggggtaaccaaaaatttcggaattcatcagatttccaaagcgaatgcaaatacaaactacggctaccgccggaatcatacggtcgaacaaccaccatacgctcttctttgtcacctttttcgaataccatatcaaagccagaatcagggcaaaaacccctccgtggctggcaagccctcctttccagatcttcagtatctcaatcggatgtgctccataataatcccattcatagaacaggcaatgtcccaaccgggcaccaatcacactactcacgatgcaatatacaaacaacttgtcggcccaatagtcgggataaccttccttcttgaacaaacgcgatactatttcataagcgaggatgaacccgattccccacatcagtccgtaccagcggatttcgagggaccctaaatgtactaacacaggatctacatcccaaacaatacttgctaacgtcataataagtctttccatttttaattatgcaaacgcaaagaaaataaaaaaaacagtttttatccattagcatctgaatattttttatttgaactagagaaatattcctactacttatataaaaatgcttccgcatcagtgaatatacttttaactaacaatacccaataatacggaaacattcttttataataaatatctatttgaaaacttcatcaactttccaccgttcattccatggaatagttatattcccttcatttgttatagaaacagggagccatacgtaacgtgaatcctgaagatttgtcttattccagcggtcgaacatagctatataagcattattcattccatgtacaggtaagacgaaagtgctctgtgcataaaatgttttatcagcatcctttcctacacatggattacctatagtcgtccatggtcccattatagaatcggcaactgccaattcagcctgattaggatcccatcctgtacaaccagaagaaagcaaataatactttccgttatatttaaatacagcaggagcctcacgactcataccaataaaattacgtgtaaagtgtccgttaggtttcaagtaatcgctggtcaattcacttatatacattgtcttattatcctctgatgagtaaaaatgataggcttttccatcatcatctacaaagaccgtctggtcacgactcatcgcattattaggccggaaacttcctaaatatgtaaaaggtcctactggagaatcacttactgcaactcccgctgcagccttcaaataatcgggactatcaatatgcatccacataacaaacttttttgtggccttattatagacgactttaggacgttctaatacttgagatggatgtaagtcatgtaatgtatcattctttacggctgagagtactaaaccttcaaacttccacgtagataaatctttcgaagaataacaactcactccagacacatcggtacggaaacactcccatgtagcccattcaggcaacacagtcttaccaagcttatattcaccataccaataataggttccttcatgataaagtattcctcctccatgggcatttatcggatgaccatcagcatcgttccaaacttctccggaaacaatttcagaagaggtcatattcttcttttgtgatgtttgacatccaaccataagcagcaaactcactgcccagcaacaaacttcttttttattgataaatctcatatattttcagatattacatattagtcagccaacaaagatgtaaagaaccgttctattctttctttgtcaacaaaattacatttataattttgaatttcttttacagtcaataaatcacgcaacgccctatatcctgaagaatctctttctaataccattttctgataaaacaacttactattagatgctatacatttctccggctgattttcaaacttcccgacaaaaatattttcatcaaatagattattagtggaatgagtcaaatcaaaacgactcacttctgccgtataaaagacattttgtctaaaacaagtgctatcagcatatccatcccaaaaatcagaagttaccattgtacggtcgatatctttagacattttctgattaagatgaataatattacgttctcactactgtccaataaaagttggttaatgggcctttgaaattgttgaaatacagtcttttaagcagtattttagaatgaaacggatttgaattcgtagcttagcggtcaaattgaatgccgcttatgaaccaagataaatacgtattcgctcaacttaccgcttttatgaacagaacacaattcaataactttgttcgcaagtataatggtaatcgctacgtgaaacaattcacctgctggaatcagttacttgctatgatgttcggacaactgagcaatcgtgagagtcttcgcgacttaattgtagcttttgaagcgcatcaagccaagcaatatcatcttggtctgggacgcaatccaatagccaaagccaccctcgcttatgctaatcagaatcgtgactacagaatctttgaagacttcgcattctatataatgaaggaagcttgtgaaaagcgagcgaccaacatcttggatattccagggaataagtatgcttttgattcaacaactattccgttatgtctagccacatttccatgggcgaagttccgaagaaagaaaggaggtgtcaaagctcatgtcttatatgacattgaagcacaagttcctgccttctatactgtaaccacagcatcgaagcacgactctacagcgatgtgttcaatccattatgaaccaaatgcttattatatattcgacagggcttatgactcttttaaggaactatataggatacacctgacaggttcctttttcgttgtcagagctaagacgaacttgaaatacacaatggttaaatggaagcgtaggatgcctaagtatgtacttacagatgctgaagtgaaactgaccggatacctctcagagaagaaatatcccgagtcattccgactcattcgttactatgatgaagagggtgaccgtgagttcactttcctgacaaacgcaacacatatttctgcattggacgttgctaatctctacaagaaaagatggttggtcgagctattcttcaaatggctcaagcagcaccttaaaataaaaagattctggggcacaacggaaaatgctgtccgcattcaaatcagtgtagcaatcatcacttactgtctagtggctattgtccaacacgatatgcaattgaagcgctcaacttatgaagttttgcagattctaagcatctctctaacggacaaaactaacttgcgtgaactgttcgataagactgatttcaacgatgtcaaagaactcgattatcccctttttgaaggactatttgattaattttttaactagtccatttttattggacactaatgttacgttctatcaacgtatttcttacaggtccggctatatgtattcctggagagaacattccttgacgagttcgcttaggacgtataccatctccaatactgatattatagcgtataatacttcccgtatttccacagctataacttccggcaccaccgttatcgcatactaataccatacctccgtaattatcgtgactataattatattgtatcaacgtattgcgacaattataatccgaatcaaaaccttgcgcatcccatggagccttatgaccactgacttcattaaactgtatgatagtattatcgcaactccatggccatattccagcagctgcctccgtcataggtaagatatcaggagaatcaaacatcacattatattctatcaacgtactatcacaccctatgggaacgatgccatctccaggtacctgctctatcagattatttctgataattgtatgcttattggggaaccagttccgacgatcataatatccagaccatattatagcattgcgagagcaacgcaagatatggcaattttcaattattaaattctcataacgtgataagatactgtcacctccatttacaattaagataccactaccaccaccttcttctttaactaaagagccattcacgtcacgtactgtcacattatttatcctgatattatgagatactccgtaatcataacactctaccttcagaccagaacgtccaggtaaaggggtattgccatgattaactatttcaaggttctgcagagtaaggtaatttgaattaaatatatgtacagcatgagccgacgaatcattccctataataattggattcactttcaattcgccataagtatctattataacaggattttccaaacttccctcagcagaaattgacaactctccacgaaatacctctccacgtttaaacaacaatctttctcccgactttaaattcagtccttttactcgttcaagagttttccatgcactttcggcagataatcctgaatttccatcatctccatttgtagcatctaaataataagtaacaggagaggatatgcatccggtaaacaataaaatcacaaataagattccataataacgcatagatactttctggtattaaaataagctgcagattagacaatataacctgcagcttatattttcattttatttcaagttgtcatttaaatcagaatcgaatgatggtactgtagagtaattgcgggattcactccacgttccaagcattttcactccttcggtaatttctacaccttctgtaaccttcaccggagtatctgccaagcgatttgcaaaagtatttttcaaatcgttcatacgcaactgatcatttccgcgtactacaagtgccggataataacctgctacctcataccatgctccatccaacatttatttgcaaaatcatcagcattctttgcaaaatcctcagcagagtatgtaccacctccatacgaacgatctaacactttttgtaaacaatctttagaaaatgcatctacagaattggtactacgagtttgagcttcagcataccacagaagcacttcgctatatgagaccaaatataaagtctgactgcaaataccactattccaagtacattgttgatccgtataatcacccattgtattaccgtcttttccacctccataaagtaaggtacggaacataggatgacactcgctcataatataattaccatccgcatccttctgataccaatctataaattgtccggcatacgtatatttttcgacataaactttaccgttattgctaccataaatagcatctttacgaggaccttccggcatttctttccaaaacttgatttcagcgacagcatctccccatccgccattagttacagattcataagcctgacatacggaatgttgtgaatccaatccagaccatccccacggattatctttattgaatttaacagctaccacaccttcctgagaataaggatttgaaacatacatgaaacggtccttataattctgctctaatttataataataatctcccttttcaactccactgataacagccttagccatagtagctgcttgagaataatattgcgtctgattaagtggatatcctgcacgagccatgtaaacagcagctaaaacagcttgagcagcacctttattaatatagttattcaaattgtcgctaattcttggagcatctgtatatttcactggcaatattcttaccgcttcttccaaatcagcacaaatctgattgtaaatagcttcaaccgtagaacgaccaatcccgaaatcaatatcagtagtcaagatcaaaggtacctcaccataccaacgtactaatttgaaataagcaacagctcgccaaaacaacccctgaccttttcctattttaatttcctcatcagtggttggaaccttttccacattattgataataaagttagcagccttaatcacagaatagttcttattccatgtcgttttagaatctgcattattgtcacctacattaaaactgtcaaattcgcgatatacatccttgttaccacttgtcaatgctgttatatcatctcccatccagttaggagacaaagcatgtgctcctcccactgaatattgtacctgtgcatataatacactgacagctccatccaagtcattttgagaagagaaataattattttgcaccatttgtcccttaggatcttctgtcaggaaatcactgcaagaacttgatatgacagaaaaagccaaacatgtagctacaaatatttttgttttcataatatatctatattcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtatatttaaaattctgtattaatgttagaagttcatttttactccaaaagtaaatgttcttggtgtaggataaccacctatatcgactccactacttacatccacactctttgacgaatcatcagtaaatgccgatgctgtaggatccatacctttatatttggtaatagtaaataagttctgacaacttacagacaaacgtatgtcagcaaatttagtcaatgacttaggcaaagtatatcccagacttaggttagccaaacgaacatagctggcattttcaacccattgagtagaattagcataattcgtacctccattcagcaaagatgcaaatcgtgcattttgaggattaacatcccagttatattcataggcctctttactattgataaaagaagcatccgaaatagatgtagacatcgcatatcgaaccagattcagacggtccataccaaaggctccagttaagaacatacttaaatcccagttcttataattcacgctattgttccatccaaaagtaaagtcagggttcgcgttaccaattaccgtacggtcacctgcatcaattgcaccattattgtttaaatcagcataaacattcttaccatccgcactgataccttcccatacatatccgtagaatgaaccaatagcatatcctggtttcacgatagtagcctcatctgccatcttatcagccggagtcttaccataaatatattcattcgagcctaaactctttactttatttttcaaataagtacctgtaaatgttgatgtccattgccagtcttttgtctgaataaggcgagcattgattgaaaaatcaattcccttgttatcgatacgtcctacattggccagataatttccacctccgttatagcccggaataggttcctgcatcaaacaatcaacagtttgtttgtagaaatagtcaaaagagaatgacaaacgtctgttccaaagagcaaattccaaacctaagtcaaactgtttagtcttttcccatgtaacatccggagtaggcaatgatgtaggccagtaaccataatacaaatttgactgactaccgtaattggaataaacttgtcccaacaatcctaatgtcgaataagaagcaattccctggttaccaataataccatagctggcacgaagcttaatatcttgcatagccttaaaatctttcataaaagattcattgcttatatcccaagcagctgcaatagaagggaaatatccccatttattcttactgaacttagaggaaccatccgcacggatagttgctgtaacagtataacggtcattataattataaataacacgacctacacccgacaatagcgtttccttagaatagctgttacctaaattctttgtagcagccatattgacattccaccatcccacagtttccgtcgacaaattatttccgccaatattcatatttcgatattcggtagaagtagcttcccacacagcagtagcagtcaaattgtgcttgccgaatttattcatgtatgtcaaattattcgtcgactgcaacatcatacgaaaagcatcactattactcatactgctgtttgaattaggtccggattttgcagaagagaacgaataagatttattatcctgaaaatcaaaagcatttgttgttgtaaaagtcagtccttttacaatattaaactgtaatgacagatttccggtagcagcataagtacgaagttcactttgtgaagcagcaatagcaccgagcggatttcctccagttgtattctttcctatgttatatttaccatcctctgtaaacatatccatcgtaggatcgtagttcaaagaattatagataggattcgctttattggcaatataatcattaccattccggataccatgattaaactgtatatcagcagtcacattcaaccatttagcgacttgagaggtcagattggctcaagcagaatagcgttcattatcagaatattttaagacaccttcttcatttacatagttagcagaaagataatattgagtattctcactaccactagaaacagccaacttataattttgaaccagtccactacggaacatttcatcttgccagttaatacctttctgtccggtacgcaatgcattcaagtcatcctcactataaccgtttcccggataccagaaattataagcctctgcatattcatagggagaaagcatgtcataatgtttatatacatccgatataccaacagaagcatcaaaagtaatgactctctgaccagcaactccagtcttagtagtaaccaatacaacaccatttgcaccgcgagaaccataaatagcagtagaagaagcatctttcaatacctgaatagacttgatatcatccgtattgataccactcaatccaccttcacgaacgattccatctacaacatacaaaggttcattactcaaatttacagaattggctccacgcacacgtattctaatatcccctccaggcacaccactattttcaacctgtacaccagatacacgaccttgtaaagcctccgagatacgagttaccggctgatccttatatgacttattatccattacagccacagaacctgccaaatccgccttacggacagtaccatatcccaccacaacaacttcatccagtttttcggtatcttcttccagtttaattgtcagattcattccatcacttgtgatctgaaactctctggtaccatatccgataaatgaaacactgatagttgatccagctcttacatccaatgtaaaccgtccatcaaaatctgttatagtaccattagaagtacctttctctacaatactggctccaatgacggggtctccatttgcatcctttactacacctgttactttgtatgagtttgtctgttgtgcttgtatccctacagacacgttctcgaaattagccgatacagctaaagaacaaggaagtaataatcctaaagcaataattctgcttacattcattttcttattgttcataatatatagatttaagaattcgcaattcagtaagcacaaaattaaaatattgccctatttgaaaagtcgaaaaaataacaaaaaaggaagaattattttcctcatcttttttcctacatttttcatccttttatctatatcacaaaaaatcaagcagatacatttttgctataaaaattatgatttcctttcgtcattcattctttaacatatattctttaggtaaaaaaccgaactttttacggaaacactgactgaaatatttagggtcattaaatccaactgcataggccagatccgatattcgaattttctttttctcctgtatcatacgaaaagcagcctgtaggcgaatactagagataaaagcaagaggagtcataccagtcaactctttcagtttatcattacaagtactacgtgacatacccatttcgccagcaaattgtgcagcatcaaaatccaaatcactcaaatgagaattgacacactctacagctttacgtaaaaagatttcatcctgtgaagtataatccacttccttcgcctcaaaaatcagtttctttctagcatccccaaccgtagtatcacttttcttgagcaagttttctatctttgccagcagcacattcatattaaatagtttatacaaatatccgtcagcaccaacttcatatcccttgactcgatcaatatctgcagtacatgctgtcagtataataacgggtatatgacttgtttcgaatgtattttttattttccgacacaattcaaacccatccattcccttcatcattacatccgtcactacaatatctaccttatgctgattcaactcatccaatgcaagttccgcacaaacagactttatgacagaaaaataatcagataatcttctcgccatgatattacatagttcatcattatcttccaccaatagtaaaactggctttttcttaccctccgttccatcattctccgccggaaaagcactgatttccggtttaccagtttcttccgcctgaagttccaaaatgtctttagatgaaatagcctcatctatttcatcttcggcaaaggcctccctgtctaccggaacggtaatactaaacgtatttccctgctccgctgtactgctaacttctatctttccatgatgcagcattaccaaatctttagtaagagaaagtcctatacccgttccattcgtatgaaaacggcggtattctccctcataaaaacgttcaaacaaatgagagagtttttcttcaggaataacatccccaggattatttactgaaaatccccataatttattttcggcatcataaaactgctcaaccgttatgactccactttctggagtatatttggcagcattcgacaataagttatatgcaatcttatccaatttgtcgatatcgaaataaccttcaatttcaagatccttatccttaaagataatatgcaagtgctttttacgtaccaaaggagagaaagcagcaaccgactgacgaagaaactttgtaagatttccttctgaaactcttaatttctgacgattattctctattttcctgaactccagtatttgttgaatcaaacgagttaaccgagtcatactcacagaaaaatcctccaatacgctttttagctccggatgctgtgatctcaattcatccagtaatgccgacataatactcaacggagtaagcaattcatgagttatattcgtaaaaaactgtaactttgtgtgattcagttcctctagtttctgacgttccacattgcccagttcaatcatatgtttcaaatgcattctcttgtgtataatccggtaagcaatataactgcataaaagcaaaagaacgacatataagcaatatgcccaccacgacaaccaaggaggaggtaatatggtaataatcaattctcgtgtattatcagaccagaccccactcgaattcgctccccttacacgaaagatatattctcccggtgtcaaattattataaaaggcaaaacggtgataagccgtagcagaaacccatttttcatcatacccctccaactgatattcatacttgttcaaatccgagttgacataatctaggacagagaagctcaggttgaaattattctggttatatcgcaatgtaacatgatctgcataatccagcgctacagacagtatttcgtcatgcttagaatgcgccatattacgcacagactcattatatattttaaaatcagtcatcactacaggcgaagaatacttactggatgtcatcatatctatgtccaatatattgatgccatatacccctcccaaaaagattttaccatctttccctatgcaacaagcatttctgttaaagatatgtccttgtaatccatcttccacggtataaatttcaacagtcatcttgtcatcatttccagacatattgatgcggtacacttccaaattcgtcgttatccagatgcttccccgcccgtcattcaatatacaagatactatttccgattcctcaaaataatcatctaacatagaaacgaactgatccttatcccggtcatacatacacacaccggtttcattacctccagcccatatacggttctgattatccactcccaaagtaacagctcctataatagaagcattatgactggaaacattataacaacgtacatcgtacttatttcccgtacgtacaattctccatattccagcaactgcagtagcggcccatatatctccatttttcatcctctaccaacttaaaaacagatgagcgagaaaagtccttattcccttttccggcaagctgttccaaagaatggagtttaccagaacagtctaacatgaaaagtccggaacgcgaacctaaccataaatttccatcacgatcttccagcacagaataaatacatacatccttcagtaaaggataagatttatcatttatcaccttaacacgcttcccatcatacaaccatacgccatcatcccaggtagcaaagcaatattcaccggttctttttctctcaatgatttcattcactgtagaaatagggggcaacgaagcgaactccttaaaatgattacaaggagtgacatccttcgttctataattatacttcacaagcccaaaccccatgattccgagccacaaacatccttcattatcctgaaatatgcttctgacagaactggtaggaaagaattttctcaactcagacaatgtatcaagttcagaacgactctttctcgtattgacagtacaaactcctcctccaagcaaaccaatccacatcaggccgtcacgactacacaatagagcattgacctcattaaaaggcagatcatccgtattgtttcccggcagataatttgtaaagttcccctttccctgagccgactccataatactcagcccgctgcgagagcctatccacagttttccggtattagtatcttgagcaatggaataaattatattatcggcaatactattcttttcattcgcgtcgtgcctatagcggacgaaaaaataatgctgcatatcatacggatttttcaaattcaataaaccataccgccatgtgccaatccagatttctccacttttatcctgaaacaatatatgggcggaatttccaggatttattcccttatacgataaaaaaatatccttttcatggtcataacgccataatccctgattccaggtacctatccagatatcccccgtatggtcttccatcagcgattttatattaaggacttctggaatattgtcacaatgacaaaaatcattttcgccagctttcttccggtataacccttttcccgtaccaacccatacgtccccgtcggctccacatgttatcgcttcaatataactatcggccgaagacaatcccgacaaaactattttctctaccttatcttcacgcttgtcgagcatgtacaacccattatgggtaccaatccacaaattacattttttatcctccctcactatattaacaaatccatcaatggaatggtccctattctttgcatccggacgatacattattgtagaatatccatcataacggagtaagccactataagtagcaatccagatatatccttcactatcctgacaaagattacgaacttcatttgttggcaaaggcaatatagtcttcagagaacgaaaatgaagagaagaagagaatgcagacactattccccatagaaatcccattagcaagaagatatagcgtttcatgtttttacatagtatttttgacaaaaatactatttttttcacttatgaacaatagaatccaccttatttcaataaagcagaaagcctgttcttacccaaataagtaagaacaggcttttatgaattctgtatttatatactataatagtataaggaatctaagttttataccaaatgagcaatcagttcttcacggtcgccttccagcaagtcgataaccggaacttcaatcattgtataacatcccggctgctgtttcattgaagcacgggcaacgcataccagtacctgagcagtaagtgccggattgttgatcttcatgtagaactcgaacaactgattgtgagtcttacccgatacgcctttacgtaccagattcacaccatggcccacatcgttcaaatcgtcaacgcaaggaacctgaataacatgagtttcatcgtttacgaaatacgcatcggccttgatggctgcttctacagtcttgaagtcagcaccttcttccagttctacataaaccatacggcggtgaatacctgtacccaccggaatagtcatagacaaagcatcctttacccccggaatggcacgtacggctacagagtgtcccatactacgtcccggaccaaagtttgtataagtaatacccttggaagcaatagcctgcaacaatgtgcgtactactgagtcgcttcccggatcccatccggcagagataatagacactgcgttgtgagccttcgctgtttcacccagtgaacgacgcaaatcggtaatctgtgtgtgaatgtcgaaactgtcgactgtattgatacccaaagccaggatttcctttgcatatttttctacactacgggtcggagtggcaagaatggctacatctacatcctgcaattccttaatgtcctttactaccggatagtttgccagttctgcaggcttgttttcagctccatgacggcgaacgataccggctacttcaaagtcagaagctgcttcgagcgcttccaatgtaaattttccaatatttccgtaaccaactacggctgctctaatttttttcattttatatgtgatgtttgatgaattcttttttcgacgttgcaaaaatacaaaattagaattattctaaagaaacagtcaggcagcgattttgaaataaatctgcacaaagttacgatttataactttcttatagctatttttgcactaaatttatcatttatcagaaaaacatgatcgaatatatcaaaggagaacttacagagatcacaccggcaatggcggtagtagaatgcaacggtctgggatacggcataaatgtttcgctgaacacttattccgccatccaagggaaaaaagaggtaaagctgtatatctacgaagccatcagggaggatgcctatgtattatacggctttgccagcaaacaggaacgggagttattcttgctcctcatcagcgtatcgggcataggaggaaacacagcacggatgattctctctgccctcactccttcggagctctgcaatgtaatcagcagcggcaacgataagttactgaaaaccgtaaaaggtatcggactgaaaacagcccagcgtatcattgtcgacctgaaagacaagattgccaccaccgatatgggaacctccgcaacggttgcttccgtcgccatggcggccaatacagaaatctatgaagaagcagtcgccgcacttaccatgctggggttcgcacaggccccttctcaaaaagttgtttcggccattcttaaagaagaaccggaagctgccgtagaaaaggtaatcaagctggctttaaaaaggctataaccagattaccaaaccttattcatagatatacacacatatccgagcagacgaggtatttatgaaatacctcatctgtcactaatcataacatccggacctcagcgctgtttcagtgagagtccggatgttttttatcagagctaataagtttccgacaaatcaattaaagatctttattccgataaagtaagttctcggctgagtcggcccatagaaatatttcgaatcgcgtaaagcacctttatccagatctttttggaaagcattaaacatattctgcactcctccattcacttgaagcttcaagtggtcgttcagcacaaacgtatagttcagcttcaggttcagttccataaagttcggtgtatgctccagtcggtctttttcaatataaccggcaaagtgaggtacaaccatcggtccggtataaataccagaaagagaaaaatcaaagtttttcagcggagccgaagtaaacgtaaaatagccataataatccggtgtgcgaggcatacgcttgataggagctacatccgcatccttactccaactaacagcctccgtatatcgactacgctgcagcgtaaagcccaactgcaactgtgcttcacgtccgtgcgctatcttataatcgatattagccccgtatacgcgcgctccatacccgtttcgtctttcctgtatttccgcaccggtgtcggcatccttccctattcctgtcaggtaaaagacatcatttaaggaagtgtagaatccttccaccaacaaatccgactgaaaatgtccgatgttgaaactccagtcaacagaaccgctgaaactattcgaacgttcaggtttcaacccgtcggccagccggataatcattgcttcaccacctacagccgctacgtgcaagtcttcatcataagcctgcggagcacgaaagccggttgaccacgtcaaacgtccttgaagcttatccgaaggcttccatagcagatttacacgcggactgaagataacattatctatcaggttatgcttatccaggcggaaacctgccaacagcgtaaaatagttcatcttccactcattctgagcaaacccgctgattattctcacattctgccgtaagtcgcggttgtagcccgtcatcacgtcgtgcagcgaattgtagttatattccagtcctccggtaaaggtagcaggcgagaaaagacaatcgtccatatttcctacatacatggctcctccgacggctgtcaggtcctttgtccttccgtaggcattgggattctcttccgctccataataactgttacggtcgatatgctgtgccgagccatagacagacaacttatgacgatattcattgaaaaagatatcataggtcagccctccgctgttaataatatgcttggtctgttccgtaatgtccgtttcgtgaggctgaagatcgaatttatttccaccacggcggaactcattcgtcgtatgatactccagactgatgcggctgaactgtgtaggacgataataagaacgtaatccaaacgtattcatgttcagctttcccagctcggagaagccgtccccgtcggcatcatacggattacggttacggtacgactgatagagagcgatgccatacgaattgtccgatgaaacaagcgaagcattagctcccatatattgctcccatacctttccattcagattcgacatggtagaagctacctgaaaagaattgctcacaggatctttcgtaatgatattaatcgttcctcctaccgcattggcgccaaacaatgccgaaccacctcctcggactacttccacacgctcaatcatgttggtaggaatctgttccagcccataaacacccgaaagagcactcattacaggacgactgtttatcaatatctgtgagtaaggaccttccagtccattgatgcgtacctgtggaaatccacagttctgacaattgttttccacacgcaatcccgactgataactcagcgatttcgccagattgtttgagttaacggtttcgaagagtttattactcatcacattcaccaccaccggggcgactttccggctggtttcatttcggttggcggaaaccaccacttcatctgtcataatggtttcttcttccattacaaaatgcatgtcgacagtaaaatccttgcctaccgtaattcttttggtctgagtattgtatcctatgctttgcattttcaatgtataatttcctgccggaattcccttgaaacggaaatacccttccgcatcggtcaccgttccctctcctgtttctacaatcaagaccgtagcataaggcaaactgttctccgatcccttctctatcacgtgtccggtaatgatatttccctcttttaccggctccgttgccatgtttaccaaagagcatagcaatcccattatgaataaaatatgttttatcattttaaaattctttcttttgtttatttatcctgtttctgtcgataccgacctgtaaaataagacaaaacaggtccggttcagatatgattcaagtgttctcccagttaccgttccgtaaaacgcctaccggagaaataccaaaatcaacccgatcatacacaaacaggcattcatcgattacctgtaaactaaataaaatcaaaggaaagaacctgcaggaggcgcacgcagataaagcccttccccgtacgacaacagggtatggattatctcaaaagagaaagttaataaataaagtaatggaaaatcaggacaagccgcttccaccgcatgccagtccagcgaagcaaaggtggacaaaaaatggagcgtcagtgcctgactggccgaatgagaatggtgctctgtaaatggatgcgaatggataacaacaaccccgttaacctcgtgcatgtggacgtacaatgctgttactgagtagtacaccacaaacaaggttaaaaggctgaatgcccaaaagcgcgtatggcacgtttttaatctcatctgcgacaaagatactcgaagttattgtatcttaaaaaagaaaaaacttaaaacatattatatcgtcatcgaaaccggttcagatatgggctttccacactgtatagaagtatcatataagaataaatgagacacaaaacacaaatgtcataaaacaaaaaagcgactgttcatttatttgaacaccgccgatttcctaaagaacccccatttaagggttcttgcatcttttcctcatctagttgttttctttttgttatccttttcttcttttttaccttaaagcaatttcactaatcctatctcaactaattcctgaaaacatttacctttttctaataccttaaaaaacctaaacttaataccttaaatctaatacctttctaaaattgcttttttaccttaattcctaatacctcttaattaccttaaaatctagtctaatacctttgtgtatcttgttatcttttggtttcacaaccacgatgcaaaggtatggctttctatttaattagcaatacgatgagtacattttcttcaacaactatagtttttcttgatttatatcatggagcatatctttcaccctgtgtgcggcaacgaaaaatgcacttttcaagcatcatttatgcgtcaatttcaggatacgttgattgctgcttccccgaaattccagcctcggagaatacaaagactgttcaaaacgtccgtctaccagcacatcgatataggccagtatcgggctgcgttttgggtcggccagcagttcttcgtaagtatatcccgtatagcaccagatattctgctgcgtacgttcacgaaactcacggacaagaggaagaaactcctcgggcgaataaaacggatctccccccgaaaaagtaattccgtccaacaagggattggcattgatcgacgcaatcatttcttctattttctcgcgagtcagaggatgtcctgcctgtggattccaagattccggattgtggcatcccttacagcgatgcttacatcccgataaataaatggaaaaacgtataccgtcaccatcgactatcgtttcggaatacgtatataaataatgtagcatatagatattctgtttggatattgattcttgtcgagacataaaaaggctttcttgcatacagcttacctgtttccgaaaaaaccgatagatgctacgtgagcctgtatgcagagaaagccttcattaaataacaaacgaattaattagcagtgtttcactctgtcgcgctcttccgcacgctttgccgagttccaactattcaaatctccagtcagatatccggtaatgcggcgcatgcgaagaatattctcattgttacagataggacatttatcgtaaatgacgcctttgtagccacagttatgacacgtatccaccggatggttaatagaaccataaccgataccttcgtcgtgcatcacctttacaatcttggcgattgctttcacatttttctgtgcttctccatccagctctacataagtaatatgtcctccccgggtcaaggcatggaaaggagcttcacattttatcttttccacgatgctgataggctctttcacatcgacatggaacgaattgacataataatcgcggtcggtcactcccggaatcacaccgtacttacgacggtccatgcgtgtaaaccgtccggaaagtccttcggccggagtagccagtaccgaataattcaggtgatacttctccttatattcatctaccacacggttcatctcttccaccgcctcatatagtgtatcccatgccttccggctatgtccgtgtccttgcccatacaaagccaccatcgcgttgtgcccgccaatgaaaccgattcccaatgttccctgtttcagtacgtcacctacttcatcgttcggattcagcttgccgcctcccttccagacattgttactcatcatgaacgggaactgacgtgccagtgccgtacgctggtactgataacgggtataaagctgttcggctatgaaaaccgccatatcgtgcacagaactgataaacgtatcctttgccagacgttcgatggcatcctgtccctgatttttggccacactctccgccttgatacgtgcctcgatggcaagacgcggcagattcatggtagtaaacgacaggtttccacgtcccaacgaggtcttttccccattcaggttctcgaatacacgggtacggcatcccattgtcgccagttcatagcgatagcgtttcggatcgttcgcatcccatttttcatgacggttgaaaggtgtatccaagaacatgaagttcgggaacaaagccttggccgtggtacggcaggccttcaggaacaagtcgaagttaggagcctcaaaggtgatttttccttccattgcagcgtcaaagtcctccatcgcacgcttgtaatcggcctcagaataagacactccgtcttttatcttgaatatctggatagggaaaacaggcacttctcctcgcgtacccagtccttcgatggttgctttcagcagttcctctatcaccatgcgtccttcggccgatgtgtccgttccgtaattaatggaactgaaaaccacctggtttcccccacgcgaatgcatggtattcaggttatgaataaatccttccatagcctgatgggtatccttgcgcacctgactgtaagctttatgcaagatgtgctccagttcatcggctgtcagtgcaataccttgtccggcgcctgccgaaagaaacgagcttttctcgtcttccgctggaagtatcgaagtaaaatactgttgagccagtttcagcaccaccgcctcatccagttgtacatttttcatatcgagataaaaagctaccgacgaagcgacagctttctgaaagcttttcagaacacccttagccatgaaaaagtcgaaagccggaatagcctgtccaccatgttgctcattctgatttgtctggaaaatgatggttgccagtgtagcatagctctggatagactgcggcgtacggatgcttccgttcttggtatgaaagccgcgttcgaacaagtcatccagatcgtactgaatacaggttgtcgtcttggtgggataataatcaaggtcatgaatatggatatctcccagctgatgcgcctcagcgtattgtttcggcaaaagatacttataggtataatccttggtaatctccgaagcgaaagtcatcatctgtccggcaggcgtatggctcgacatgttggcattgctcaggttcacatcattcttgtcgatggctacaataccgtccatgatatgcttcatctgcgtcttgcggtcgcgctccgtatttctccactggcggtaaatgatatactttttagccacttccggctgcaccttcatcagttccgtttctacgagatcctgaatttcttccacaccgatggtaggattctcaaaatgtgcaatcacacgccgggtaatctcgtcaatcagttcttcctgatgagcaattcctgtggcattgaaggctttactgatagcatttgtaatctttgaaggcgaaaagttttcccgcttcccgtcacgcttgatgatacagatttcagttaaattcatacttgtttgctttgaaaagttaataaaagattggatctgcttctcgtggcaggtcttctgactgatctctcccgcaggcaccttcccattgcttccaaacaacagtggcttgcttatgcattgcctacggttcattaagaatcacagcagcgggtactgttgccgatttacacggcattcccttttgaaacgcttatgttacctaacgaaaagccttacaaagatatgtttttggataaataaataaaaacgaaggaagtgcacaattttctaaattgaacaacttttcagaagataaaatgcgctacagatatttgcaggcggcataaacagacaactattatttatatcaacttttctatttggataattaaatttatttcttatcacacgaaaagtaataaatggccgctctgtcattatcggtttccgccctgaaaacagggcagaaaaccaaagaaaaaaatgaaattctattgaccgacgggttccagtcccatctgttttgccttcttgagcataaactcgaaagcagcatcgtgctcattgggtatgacaccatccagaatagcatccttgatggagctcttcaggctgccgatttcccggcatggctgcaagttgaagactttcataatctcggcgccatccaccggtggctggaaattacggatgcggtctttctcctcaaggtctttcagtttttgacgcaccagcttgaagttgtcgagaaaacgctgtttgcgcacttcatttttcgaagtgatgtctgcctcacacagcagcatcaggtcgtcaatgtcatcgccggcttcgaaaagcagacgtcgtacagccgaatcggtcacctcttcatcggcaattacgataggacgcatgtgaagtcctaccagtttctgaacgtacttcatcttttcgttcatcggcaacttcatcttccggaagatttcgggtatcatcttttctccgatgaaattgtgattgtggaaggtccatcccgcacgggcatcccagcgcttggtacgcggcttgccaatgtcgtgcagcaaagtagcccaacgcagccacaggttatcggttaccttggcgatattatccacaacttccagcgtgtgataaaaattatccttgtgtcctcttccgtttctgacctctactccctgaagggccaccagctcggggaaaatgagttccagcagcccgcagcggtccaggtcgacaaaccctttcgaaggaaccggagaaagtaaaatcttattcagttcgtcggcaatacgctcgcgtgaaataatcttgatacgctcacggttacgttccaaggcctcgaacgtttcatcttctataaaaaaattcaactgagtagcgaagcggatacagcgcatcatgcgcagagggtcgtcactgaacgtaatatccggatcgagcggagtccgtatcgtgcgctctttcaagtcgtccagcccgccaaacgggtcgaccagctctccgaagcgtgccttgttcaggcatacagccagcgcattgatggtaaagtcacgacgattctggtcgtcttccagcgtcccgttctccacaaccggcttgcggctatcgtggctgtacgattctttccgagctcccacaaactcaacttccacgtcgtggtacttcacctgtgccgttccgaagttcttaaatacggatacgtgagcaccgcgccccaacttctttccgaacgcttcggctatttctattccgctgcctaccaccactacgtcaatatctttcgacggacgattcagaaagatgtcacgcacgtagcctcctacaacgtaacactccagtcccagttcgtcagcggtttcggatatcagattgaatattttgccagtaaagtgttctttcaattccatgtctattacaaaattagcgtgcaaaattacaaaaaaatgaaaagcctcgcagggaataaccgatttaattgtatttttgttgcgtaataaactggttaattatatgaaaaagataactttagcggccgctgctctggctttgcttttatcggcatgcaacagcgacagcaaaaatgccgggaaactgttccagcgtgcggaactggctttcgcatcgggcgattacaatcttgcacgcttgcagatagacagcatacgtacttattaccctaaagctgtagacgtacggaaggcaggtatccagctcatgcagcaaatcgacttgcaggaacagcaaaaaacgctgacttacctggacagcatgatggtcatcaaacaggctgaattcgattctatcaaaggcaacttcgtgctggaaaaggatacagcttatcaggaaacagggaattacttctacccgactcaggtcgtagaaaagaatatcggacggtctttcctgcgcgcacaggtaaacgaacagggtgaaatgtcactcacgtctatttattgtgccggaggaaacattcatcatacggctgtaaaggtaagtgcaggcgacgatacttttgccgaaacaccgccttcaaacgacagttatgaaacaaccgacctggggcgtgccattgaaaaagccgactacaaagtgggcaacgacggaggagtagctgcctatatcgcagccaatcaagacaagaaaagtctcaagctggagtttatcggcgaccgcaattatacgacaaccatgtacgccaacgatatcaaggctattacggaagtcagcaacctggctcgcatccttgccggaatggaggaaatacgcaaagagcagaaagaggcaaacctaaaaattcagttcatcacccgcaagatagaagagggagaggcaaagaagaaataaccgattataaaagtatcatatagccataaaaatagtcatattgtgattcgactccagagtcatgatatggctattttctttagcagataggtatatagctgaaaaagagtagtcaatcggcttttttgaattgtataataaagattccgcatcgattgtgaagggcgtgaagggcaaaaagcccgataaatttctttatttacaggaagaacccggcatattccaacaaatttgtcccgacgttttccgaaaatttgtacaaaagttttttgtttttgtacaaaaaatagaccgttcaatcagggataaacgtttaccttacggcaagttccatcgcactccccatcatctttctcacttacctgactttcgtacaatcaagatacttgcttcatataaaataaacatgggaaaggtgaccatcaacaaagtaaagacatccgacgtaggcgtaataatggcagcaatgacaagcgatataaccagtgcatgcttcctgtaccgggtcataaactccgccgtcaggaaaccgagttttgcgaacagccatgccaaaataggaatttcgaacgtggttcccatcatcaggctcagcatggtcaatgtatcaatataagaatctatcgtaatggtgttttccacttccgtactcacctgatagagagccagaaaacggaaggtaaagggaaatatcagaaaatagctgaacaatacgcccagaagaaacaacacatatccccaggtaatgactctcacagaatagcgcttttcgttttcgtacaaggcaggtgaaacaaaacggaaaagctgatagagtatataaggagaagccagtatgatacccgcataaaacgatacgttcatgtgcatgaggaactgccccgacaactttgtattgatcagacgaacctgaaagtcgttcgtttcaagtccggacagatgcagaacatttcctacccacgcaaagaaacggtaaatatagaaatcgttatccttaggcatcaggataatatggaaaagctcatccttaaagaaaaaggataacagcataagagcaacgactacacacacaatccgtataagcgtagctctcaattcatccaagtgatcccagaaagtcagttccgattcattcttctgcttcacggtcgttatttttccttattttccgtcttatctgttttttcggcagaatctttcaggttctcttccaccccgttcataccatccttaaaacttttcacacccttacctaatcccttcatcagttcaggaatctttttacctccgaaaagcagcaggacaatcaaagcaatgaaaagtaattcctgcgtacctatccccataaataataacgtggtattcatacctttaaatttagtttaatcaaacagatatatttctttgccaaacaaaggtaaagatagtttttaatttgtgcaagcaagaaaaggctacatgttgctttttcacacaaaacgccataaaaaagcagcattttgccggggcttgttctttgcatacaaagggcaagtcccggacatttttttcggctgcactaaattcgttcagccactttgttccagtctatcagtttccagaatgcttccacaaatgccgcacgacgattccggtagtcgatgtaataagcatgttcccatacgtctatcaccatgacaggcatcagtccttttgtcaacggattgccggcattcgattccgcaacaattgaaagcttatgctccttatcagcaaccagccacacccagccggaaccgaacaatcccaaggctgccttcgtaaactgttccttaaaggcatcgaccgagccaaaggttccagtcaatgcttcaaccagttttgccggcatttcaggctgactggcagtcagactctggaagaaaaaagtatggttccacgtttgggcagcattgttaaagattcctccgtccgcctttttcacaatctcttccaaaggcattgcttcataaggtgttccgggaatcaatttgttcagattatctacataagtttgcagatgtttaccataatgaaactcgagggtttccttactcatatacggagaaagggcatccatcccgtaaggtaactgaggcattacatgtgtcataactgtagtatttaggttaaacgatagaataaagctttcgcatatacaaacttaacttttatttttgaaaaaaagaatatcagcaggcaaaagaaacagattcggcaagcataatcaagcaattgataactcctcatagcaaaacgccacgttcaaatttaaaaatagtgaaatttttccgtaattaagtcgaaagcccgcagatttacccacttttacgtaacgaaagattcgtttttacaaaagaactttcctatctttgtagcgcaagaaaaaagaaatacacttttataacataacttaaataataagaattatggaatttgtaactaacgaaaaacttaccattgttggtgctgccggtatgatcggttctaacatggctcagactgcaatcatgatgggtctgactccgaacatctgtttgtatgacccgtatgctccgggattggaaggcgtagctgaagaattgtaccactgcggtttcgaaggcgtaaacgtaactttcacttctgatatcaaagaagcgctgactggtgctaaatatatcgtaaactcaggtggtgctgctcgtaaggctggtatgactcgtgaagacctgctgaaaggtaacgctgctatcgctgaagaattcggtaagaacgttaaacagtactgcccggatgttaagcacatcgtagttatcttcaacccggctgatatcactggtttgatcacattgctgtactctggtttgaaaccaagccaggttactactttggctgctttggactctactcgtctgcgcagcgaactggctaagcacttcggcgtatctatggacgctgttgaaaactgccgtacttacggtggccacggcgaacagatggcagtatttgcttcaactgcaaaagtaaacggcaaaccgttgatcgacatgatcggtactgacgctttgactaaagaacagtgggctgaaatccagcagaaagtaacaaaaggtggtgctaacatcatcaacctgcgtggacgttcttcattccagagcccggcatacgtttctatcgaaatgatcggtgctgctatgggtggtaaagcattccgctggccggctggtacttacatttcaaatgacaagtacgatcacatcatgatggcttgggaaacttcaatcacagctgacggttgccactgcgctgctttgaacggtactcctgaagaacaggctgctttggataagagctatgctcacttgtgcgaattgcgtgacgaagttatcgcaatgggtgttcttccagctatttctgaatggaacaaactgaacccgaatatcaaataatttatatttcgagtataacaagaaaggagattgattcgtcaatctcctttttttattaccgtaactgttactctatccttgccccggcagtacttgtttccttcttttcagaacgagagatatcagtaaaatcaactcatactgaattttttaacaaaatcagatgaaccatctttcagtaaactccgttatataaactctaatagaactaataacggatgctatgaaatcaagaactctccttctccttttctgtctgtcattttgccgcctctctctacatgcacatcagggaaacaaagaatatacctgccaaccaaacgactcgactgcctgtgtaagccgaacaaaagagaaaatacgcatcaccgccacagaaagtttcaacagggagttttcatacatgggtataccgttcattacagccggactgattgtcaagaagcaaaacagtgatttccgtactttacgcaaccggtttaagcccgaatttcatcaccgatacgacgactatactcagtatgtccctctggccgcaacctggggattgaaactggcaggcgtacaaagccgcagctcgtggaaagaactagctgtcagcaatgtcttttcggccgcattaatggccggctttgtcaataccctgaaatatacaaccaaagagacccggccagacaatacctcgaacaactcatttccatccggacatacggcaacagcctttatgtgtgctacaattcttcacaaagaatatggcatgaaaagcccgtggtacagcatagggggctacacactggcaggccttaccggagtgacacgccagctgaacaaccgtcactggattggcgatgtactggtaggtgccggcattggaatgatttcgaccgacctgggatattttctttcagatttaattttcaaacaaaagaatatagatacatggagtttaaatgcggattacaaccgctatgatgcgccttctttcttaagtttcaatatggggattgcatccggtccttctaccttgcgaactgccgaattatacgattctgaaggaggatctcccctcggcatgcgcctgaaagtgggaactgccaccgtggtcagcgtggaaggtgcctactttttcaatgctttcatcggagccggaggacggctgaaagttgccaccctgcccgtcatagcggatataccagccgagaacatgaagaacttcgatatggacaacgacctgcaagaaggtgctccagtcaacatgtttctgctcgacggactggagtcggaccatcttggaatgctggacgtcgatttaggaatctatttctcgtatccacttagccgacactttcagataggaagcaaactgctggtaggacgcagactcaatgccgacttcaagctgaattctgtctgccgcatcaatccacagatttttgaccgaggcattgtaagcacagaagcctataaccaatattacaaggcagacgtagattactacatgcagcaggaaggaatcacccgcgatgaattgttgaacagcagttttgtagacgatgacttcctgagcatacgcaaaagttccacatacaaggtgggaacaggtatttcctttacttaccgctacaaggaagatgctgctttccgcctgtactgtgactatgattttgcttctccccgactgacatacgacctgaaaaactcatgggttgacgaagcaggtaaccggaatgctcactcgtataccaagaggacgcctatgcataacctcactttcggagcttccatcgcatttgttttctgagaatgattttgttcccggactccatctgtccgtcggtcaaatcatggcatcccgttccgacagaaaggcatgtaaaaaagtcattgcacattctagttatttttattattttcgcctttcgaaatgatagaccaagccaccatagaccgcatactcgatgccgcacagattgttgatgtggtatccgaatttgttactctccgacgcaggggagtgaactacatcgggttatgtcctttccacaacgaaaagacaccttctttcagtgtttctcctagtaaaggactctgtaaatgtttcagttgcggaaaaggagggaatgtagttcatttcatcatggaacacgaacagctttcgtactacgaagcgctgaaatggcttgcccgaaaatacaacatcgaagtcaaggaacgtgagttgaccaatgaagaaaaacaggcacaaagcctgcgcgagagtctgtttgtcgtcaaccagtttgcatccgattatttccaggatgtactccataaccacatcgacggacagcgcatcggtatgacttacctgcgtagtcgtggtttccgcgacgatatcatcaagaaattccagttgggatatagcctcgacagccccgatgcgctggcgaaagctgctctccaaaaaggttacaaagaagagttcttagtaaaaacaggactgtgctaccgcaaggataacggtacgctgcacgaccgtttctggggacgtgtgatatttcccgtgcataccttatcgggaaaagtggtagctttcggcggacgtgtactgagtgccgccaccaaaaacgtacaaatgaagtacgtcaattcgccggaatcggaaatctatcataagagtcgtgagctttatggcatttatttcgccaaacaggcaattgtccgtcaggaccgttgctttctggtcgaaggatatacggatgtcatttccatgcaccagagcggcatagaaaacgtagtagcctcatcgggtacggcactgaccgccgaccagatacgactgattcatcggtttaccaataacatcactgtactttacgacggcgacggagcaggtatcaaagccagcatccgcggtatcgacatgctgctggaggaaggtatgaacattaaggtctgccttttgcccgatggtgacgacccggacagctttgcccgaaagcataatgcaaccgactatcaggcgtatattaatgatcatgaagtcgattttatccgcttcaagaccaacctgcttatggaagaggcgggtaaagaccccatcaagcgtgcctcactgatttcgagcatcgtaaaaagtatttcagttattccggatgccattgtacgctcggtgtatatacgcgagtgcagtcaattgctacagatggaggaaaagattctggtagaagctactgccaaactgatagaacaggcaagagaaaacaaatttaaggaagaacagcgtaagcaatatcgggaacggcaattagcttccaatgcttcgacagccaatcaaacaagctcttcctcgtcgtctgcccctgctccgtatgccgctacaggagaagaagtgcctttcagcacgaccaatgacattcctctgccccctcctccagccgaaagcatcggagagagtggaatcacagccgattttcctcctgttgaaacaatgggacaagagagtgtaccttcgcctgttcctgatgaaattccggttgatacctacaattcatatatccccaccgaagggaatgaacagaaagtcttttacgctaaggaagaagacctgatgcgcatgattgtacgatatggtgaaaaggttatgtgctatatggaagatgaaaacggagaacagcaaccgcttaccgtaaccgaatacatagcagaaggattaaaggaagacgaattgcagtttcatgttgcgcttcatcgacggatgctgaaagaagcagaaatgcacatccacgatgagaactttacggctgaacattatttcatcgcacatcctgtgccggaaatcagtaaagcagccgtcgacctggccagcgaccgctatcagctcagcaagtatcattccaaaggacagaaaatcgtcacggatgaagaacgtctgtacgaactggttccccgcctgctgctcgacttcaaattatcgattgttgatgaggaaatgaaacatacgcttcaggcacttgccaatccggagatagccaacaacccgcagcgctgcatggaagtaatgaaacattacaaagaactgcatgaaacacagagcatcatggctcggcgtgccggcgaccgtgtagtattgaaaatataatcttctctgccgtctgttggaatcactcaaaagagttggttgcatcaattcccaattgcctcaatagggaaacgatctcatcgaactttttcaccggaaccctttctatcggatagcagtgataagcaaaatcggcatccagaaactcgatgaaggagataaactcgtgacccacaaaaggtgctgacgtgaaattaaccttccgaaggtccgaataagcaaattttacaagttcatcttcatcctgctgcaagaccatttcttgcggttccagcgtcagtgcatactggcaagagataccctgataaagtgtaaaaaatgaaagtcctacatgctctattcctatcaatgacactaaaaatcccgccagccatacatgaggagttacaaaaatcatccaacatgacaagaagaaaaaaaacagtccaaacagcaactcaaaaattccccacctacgacgcgaacgcattttctttgaaaactcatcataagtacgaattgacgacagcctatccaactgcttgaggggagtttcataattggtaaaaggaatcttccgtaccagcagatattgcacaatccaagccggattcaggcgaagtcccatattcaaccacatgccttgcagttgtgccccgcgtacaaaacccgatttcaaggtaaagataaacacacccagtccatacagacaacaccaataaggtttgcatttgctgggacgaggcttatagtattgcataaatgtaaaaccagccacctcttccacattcacgtgtttgcgttttagccagcgttccaccttgtatgtttcctcttctgtcaattccataacgctttcttcttaaatgtactacgaaataaccgaccagttcacattctttttccgaagttccttcaactgctgccatacgatagcattttccggacgctctccattcggatcggcatcgagcaatcgctcagctatctcacgcacatactgcaagagctgtccgtcgcgggcgatatcggctatcttcaaatcaaatgccacaccactctgctgtgttccttccaaatcacccggtccgcgcaacttcaaatcggcttctgcaatctcaaaaccatcgtttgtctgcaccatgatttcaatacgcttacgcgtttcttccgtcaacttatagccggtaaccagaatacaatacgactgatcggctccacgtcctacacgtccacgcaactgatgcaattgcgacaagccgaaacgttccgcattctctatcaccatgaccgaagcattaggtacgttcactcctacctcaatcaccgtagtggctaccataatctgagtttcgtttgccagaaaacgctgcatctcctcatctttttcggccggcttcatcttgccatgcaccttgcttaccttatattccgggaactcctcacagatatgcatatacccgtcttccaggttcttgatatccatcttctcgctttcctgaatcaacggatatacaatataggcctgacgcccttcctgtatttgcttccgtatgaaagcatacattgaagcacggcgattatcgaactgatgaatggtttggatgggttttcttccgggaggaagttcatcgatgacggacacatcgagatcgccatacagcgtcatggcaagcgtacgaggaataggagtcgccgtcattaccagcacatgaggcggacaagtgttcttcgcccacaacttggcacgctgagcgaccccgaaacgatgctgttcgtctatcaccaccagtcccaacgaagaaaagttgactgtatcttctatcactgcatgagttccgatcaggatctgtacatctcccgttaccagatcttttaaaatcgtttccctgcgcttcccctttacgtttccggtaagcagctccacccgcacattcatgcctgcaagaaaacggcatatcgtttcataatgctgagttgcaagaatttccgtcggggccatcatacacgcctgataaccgttgtccaaggctatcagcatggtcatcaaggcaacaagtgtctttccactacccacatctccctgcaacagccggttcatctgacgcccgctacccatgtcacgccgcatctccttgataacccgcttttgagctcctgtaagctgaaacggaagattctgtgaatagaaggtattgaaaatctctcctacccgtccgaaaaccagtccgcggaatttatttcttctttctttagtgtaacggaggatattaagctgcacataaaacagctcctcgaacttcaggcgatactgtgctttccgaagcaaatcgggattctgaggaaaatgaatgttataaagcgcatcagtaagcgacatcaggcgatgctgcgccaccagttgcggactgagcgtttcttctataatgtctttctgaagtgctccgaaaagattcttcatcagcttctccagcgcatgcgaattgaggttgctgcgcttcatcttctcggtagtattgtaatatggctgaagccccatcgacgaaagagtaagctcttccgccggatcaatatcgggatgagcgatgtttatccgcccgttgaagacggtcggctttccgaatacgatatactcttcgtgtgccttatagcgccccatgacaaacttcagcccctgaaaccacaccaagtcgaccactcctgtcccatccgaaaaatgtccgaccagacgacgctggcgaccttctccaatggtttcgaaactgagcacctgccccttcagctgaatatacggcatgttcccgtctatctcatggatataatacagacgactacggtcgacatacttgtaagggaaataatacagcaagtcccgaaaggaatagatattcagttccttgttcagtatcgccgcacgctgcggtcctaccccctgcaaatattttatgtcacgcgtagataaatcgaacatttatttaaaccaaaacttcagcaacctttaaatcgaacggagtcgtgagcttaatgttttcacggtttcccggcaccagatataccggatgccccaaagcctctacaaccgaagcatcatctgtaaaggcagaagtatacggctgtccgtatgcctgcttcaacaaagaagcagtaaacacctgaggagtctgaaccagcttataacggtcgcgcggtacagtcacgctctgctcctctgtttccatccggcggacagtttctacgaccccgataaccggaatgacagcttgcttttcgcgggctgcatcgtaacaggcagcaatcacttcctgcgacacgaagggacgaacaccgtcgtgtacacctaccaggctgtccggatcgtcgaccagagccagtccgttctttacagaatggaaacgggtttctcctccgtcggcaacgcgatgcggaagcgtaaacccgtatgtagcacaaagctgcttccagtagtcctgctggtctaccggaagtaccaatatgatatgtatatgctcatcgtaggcatggaaagcttccagcgtacgcatcagtacaggttttcccttgattggaataaactgcttgggaatatctccccccatgcgcaagccttttcctcccgctacgacaatgatgtatttctccatcaggcgagcaacattccctttttaacttccaatgctttttcagcaccggcaaacttctccagaagagcaaaaccgaaagctggagcagcacccggacctttacccaagatgaagttatcaacgatttctaccatgttgccagtatattctgcaccttccagatacttgtcgaatcccggatagcaagtagccttcttgcctttcagcaaaccacgcttgccatataccatcggagcagcacagatagctgcaagtggtttcttagccgcagcaaagtccataatcagtttgtcgagtccggcatgagcatcgagattcgttgctcccggcagtccacccggcagaacaatcatttccacatcctcttctttcaagtcctcgaacagcatatctgcaacgataggaacctgatgagagctgacaacagtcttttcacctgttactgatacagtttttacattcagtcccccacgacgcataatatcgagcggaaacatggcttccatttcttcgaagccttctgccaaaaagatacaaattgctttcatactacaacgaatttaactattcatattttattatttatttcaacttgaaataataggttatcgtaccactctgattatttaccccgtctactgtattgaaacgggcgcggcgcgcagcttcttccgcagcacggcgcaaagcgggattcaccgtattggtccgtttgttgatgcttgtactgataactcttccggcgggattcaccacaatcgtaactacgacacgtccttcatcctgcacattatatacaggaacaggtaatccaccagagcctagcgaacgaccattcaagtcgaatgttccatatcctcctacacccgaagtctttcccgtgtttccattaccgtcaggacttccctgtatgccttctcccgattcggatgtacctttactgcccatcttggagccttttccgaaagctcccgcaatcttgctggcagcagcctgagcagccgcacgttcttgttcggcacgcttctcagcttcggtcttttccttaggctttgtaactacaggctttgtttccggtttctttgtaggcgtaacttcctttttaggtttttcttccttcggcttttctttcttcacctgaatggaaggttcatcatcctgtgtaatcataggctgcttcacctcaggctccggagtcgtttcgggttccggcacagaagtttccggctgcggcaatacgtcgacctccgtcaatgtaaacggatcggcgtcgccttgggcagtttccgtattaccaagcataaccggtactcctccctcttcttgcttttcagggcgagtaagcgagtaaaagaaaagcaacaatatcacaaggatatgcaataccactgttcctattattccggttactttactttttttcactgtattgtcttttagttctgtttgtcagggcggcgggtagccagcaccatcttgaaatgattctcattggcaatgttcaggatgcggacgatttcacgatagggaatcgactcgtcggcataaagagctacatacatttccggttcttttgccgcgcactcctgcaggaaagaaggaacttcatccagcgagagcggcatctcgtcgtcattgccgaacgccccgtaataattcaaatccttatcgatgattacccgtgccatcggtttggccgaagtctgttgggaaccttgcggcagcaagaccttaatggcattcggcgacaccatcgtagaggtaatcataaaaaatatcagcagcagaaagatgaggtcggtcatcgacgacatactgaacgccggagatattttttgtcttctcttcagtgacataggcttcttatttttcgtttggttcgttcatcaagtccatgaaagcaatggtacgtgcttccatctgacttaccaccttgtctacgcgatataccagatgattataggcaaacatggtagcgataccaaccaccagaccccctacagtcgtaatcatcgcttcatagataccacttgacaagagcgtgatatcgatgttgtttcctgcatttgccatgttccagaaggcacgcaccataccggttaccgtacccaagaatcccagcatcggcgcaccactggagatagtagccataatagacagtccgttttccagcttcgccacttcaatgtttccggtattctcgatggcagcctgcacatcggcaaccggacgtcccatacgcatgatacccttttcaatcatacgagaagaaggagtattggtaatgcggcagtaattgatagccgacttgatttctcccgtcttgatatagtcgcggatacggtccataaacaaaggatcttcctttccagccttgcggatagctaccgcacgctcgaagaaaatgtaaaaagcaatgactgacatgatagccagtaaaatcataatccatccccctttgcaggccatatcccaaaggttcatttcaggttctcccgaagctacgggagtcagcacgggattgtttcccgtcatggtgtcggcaacggtctgtgcagttgccagcaatgtcattgtaatcatattcaacgaaggcaatttttatattcttcaatagtttttttaagtcccagatagagtgcatcacaaatcagtgcgtgtccgatggaaacttcgtccacccacggaatattttcgtgaaaataagcaagattttcaaggctcaggtcatgtccggcattcagtcccatgcccaacttgcgggttaccgttgcagcctccacaaaaggagcgattgccgcctcccggtttttggcgtacatcgatgcgtaaggctctgtataaagttctacgcggtcggcacctgcttttgctgcatattcaatcatctccgtatttgttcccacaaaaatagaagtacgtatgccagcctctccgaaagtatccatcagttcggtcaggaaagaaaggtttgcctttgtatcccatcccgcattggaagtaatctgatctggagcatcgggcacgagcgtcacttgatgaggttttaccttcaagaccagatctacaaactctttcgaggggtaaccttcgatattaaattccgtacggagaatcgggcgaagggccagcacatccgcataacggatatggcgttcgtcgggacggggatgaacggttatgccttcagccccgaaagcttcgcaatccaacgccactttttctacgtcggggttatttcccccacgggcattacgcaaggttgccaccttgtttatattcacacttagcttagtcatattgaatttaattttatatctttgcgtctacaacttgcaaagttaacagctttctcgtaaaaccagttaactttacgtgacaaaagattgataaaaaaagctacaagatatgcaacgcaacctcagatttgcccttttcggaaatacttatcaggaacataagtcagcacatgccacgcatctgctggaaatcctgcgcagcaaaggagctgaaatctgtatcagcaacgaattttattatttcctgaagcaacataccaaagccaacctcgaaggactggagatttttcagggatatgattttgacgcagatatggtgctgagcatcggtggcgacggtacgtttctgcgggcagcaagccgtgtaggcaagaaggaaattcccatcctgggtatcaataccggacgtctgggcttcctggccgacatatcgcccgaccagatggaagaggcattcgacgaaatctacgagggaaaataccttgccgaaccccgacgggtattacatctcacctccgacggacatgtactgaaaggctatccgtacggtttgaatgaaatagccatcctgaagcgtgacagttcgtcaatgattaccatacgtgcttacatcaacgatgagttactctgctcttatcaggcagacggactgattgtggctactcctaccggctctacagggtattcgctcagcgtaggcggtccgattcttgtcccgcaaagcggaaccatcagcctgactcccgtagcaccgcacagcctcaacgtacgtccgattgtgattcgtgacgactgggagattacactcgatgtggaaagccgaagtcataattttctagtcgcggtagacggacgcagcgaaacttgccgtgaaggtaccaaactgaccatccgccgtgccgattacttcgtacggattgtgaagcgctgccatcactctttcttcaacacgctccgcgaaaaaatgatgtggggagcagacagtcgctcgtaaacaagctgaacaaagaataaatttgtgcagatgtcctgaaaaaacatcaggagaagcaaccggtgttttgtacaaaacatgcaagagtttgtacaaaagattttagtttttgtacaaattagaccgaaagcctcaggatgtttcctatcggacaagccgtaattatcttataaataagaggctattttcgcatagagaaaatgaatagaccgacttataatttataagttacaattaaaaagaaatctcctgccttagcctttgtttattttaataacacgggtaaaagcaggagattttttctttcaagctcaatctatccaatttttatttgagcaattttattttgaaatagccttaaaaaactgttcctcaccgcaagactgatatttatacgatgagaaacaggctgttatagctggtcgggcagcagactcagcttcatgctgttcgagcctttcaccaggatgtagtaccctttgggcttatgagcctgaatatctgccagcacctcgtctacattctgaaaggtctggaaagtatgggtcgtggcagcgaactccggccccaccagcactacccgttcgaaaccacactcattcagataatcgaccaccttctgatgttcttcgtgactcaccgtacccagttctttcatatcgcctaagataaccatcttatgaggagcttctatcagacggaagttcttgagagccgccatcatactagtcggattggcattataggcatccacaatcagcttgttgtcggcagtttctttcaactgcgaccggttattgtgaggcaaatacgatgccagcgcatcgctgatatcctcatcgggtactccaaagtaacgtccgatagctactgctgccagcatattgtccaagttatacgagccaatcagatgagtagccacttcgtgtgatatacctcctgctgtccatcggaaggacagaaatggtgagcaactgatcagttccccactcacatacaagccgggagtctgtccgtaacgcacacaagtcagcccttcggctatgccgttcaggtaaggattttcattctggataaagatagtagccccgcctttggcacgcaggaaatcgtacaattctccttttgtacggataacgccttcaaaggaaccgaatccctgcaagtgagcccttcccacgtttgtgataattccataatcaggctctgcaatgtcaaccagctctttgatatctcccggatgactggctcccatttctacaaccgccatttcatgctgcggattcaaacgaagcagggtaagcggtacaccgatgtggttattcaggttgccttctgtatacaaggtattgaatttccggctcagcaccgtagaaatcagctctttcgtagtagtcttcccgttagttcccgtaatgccgataacaggaagatgcagttgacggcgatgatagttcgccagctgctgcaaggttttcaagcagtcttctacgagaatcgttccctctcctgcatactcaggctcgtctatcaccgcataacggcagccctgcttcaaggcttgtgcagcaaatgcgttaccgttgaaggtagctccttttaaggcgataaacatcgaacctgcgggacaattgcgactgtcggtggtcaccttgccgcattccataaagcgtttatataactcagctatttccataatttctgtaacaaaactttccggcgcaaagataacgtaatttaatttcccgcgactgcgaaaaaacaaattattgtgcgtacatttgcagcgcttaaagacgtattatcggacatggaaaacagtattgtgaaacaaatcaatgtaaacgggcagttattggacttgtcgtacccgcaggtaatgggcattctgaaccttactcccgactctttttatgctggaagccggaaacagactgaagcggaaatcgtagaacgtacacaccagattttatcggaaggtggcagcatcatcgatgcgggtgcctactcgtcgcgccccaatgccgagcatatcagtgcggaagaagaaatggcacgcctgcgttacggactgggcatcgtattccgtgaatgtcccgatgccattgtttcggtagatacgttccgtgccgatgtagcgcgcatgtgcgtagaagaatacggagttgccatcatcaacgacattgcggcaggcagcatggacgaaaacatgttcccgaccgtggcacaactgggggttccttacatcatgatgcacatgcagggcactccccaaaacatgcaacaggctccgcattatgacaatgtggtgcaggaggtgctgtattatttctccgaaaaggtacagaaactgcgtgacctgggagcaaaagacattatcctcgatccgggattcggtttcgggaaaaccctggaacacaactatgaactgctgaacaagctcgaagaattcagtatttttgaactgcccatactgataggtgtctctcgcaagtcgatgatataccgtctgctgggaggcggaccagaagacgccttgaacggtacaagtgtcatcaataccatcgcgctgatgaaaggagccgatatcctgcgcgtacacgacgtacgtgccgcttccgaagccgtcaagatagttgccgccatgaaaaagttaactcctgtaagtttgtaaacataaagctatgcctttcgatttttccatactcagcgtcaaagatattatcgacatcctgctggtagcatttctgctgtataaaacctacaagctgatgaaatcgtcggggtcgatcaatgtatttaccggaattctggtattcatcatcatttgggtcatcgtatcacaagtgctgcaaatgcgtttgctcggctccatattcgataagctggtgagcgtaggagtcattgcactgattgttattttccaagatgagatacgtcatttcttgctgtcgcttggctcacgccaccgtacaagcagcctgctccgcttcttcaagggaggacaaaagaacggaaacagcaaggaggctatcatgcctatcgtgatggcatgcctcagcatgagcaaaggaaaggttggagcactgatcgtgattgaaaagaactttccactggatgacatcgcccggacgggagatatcatcgatgccaacatcaaccagcgtctgatcgagaatatcttctttaagaatagtccgctgcacgacggagccatgattatcagcaacaagcgcatcaaggcggccggatgtatccttccggtatctcacaacctgaacattccgaaggaactgggattacgccaccgtgccgctctgggtatttcacaggaaactgatgccatggcgattattgtttccgaagagaccggtggtatatccatcgcctatcagggagaattccacctgcgtctgaccgcagaagagctggagcgtatgctgaccaacgacgacgaagcctgaaatcagttcagcatcaggctcatgtacggatgaagatcgtgcaggataaaggctgtcagttcactgattgtgaatgtaacatacgtttgtccttcctgcatatcccgtgacacctttcccggaaatacagtataataaccgttattctgagggatagcctcatcgcccgttacgcagatatacaatccttctccacgataaacagcagaaaaaaccttcaggcaagaagcgacatctatcagacgggccatgcccagctcgtgcatttcgtcggcacgtggcacgatacactccagacgttctgcgcgataagaagctgcaagctgacgcaatacctcggcaaaatcggcctcatccgacagcagaatctctttgacggacaatgtatttccgtccatcaggcagaaaacaagccccgacatccccccgtttttatcgacgatccatacatctcccttgctcaaagcaagatcggataataccacgtggaagtcatcgggcgtatgttgaacacagcacgggcgcctgttcatttgttcataaaagtagggataaatgtgttccagcggagttttcaacagatctatcttactcattttcagataagatacagagttatcaacaggttgttcataactgttgataacttttttcaccaagccataatgaaaacaagttgcataccccgagcgggcataataccctttcaaccattcttcggcaggaatcaaggtagcaaacatcaccccttcggcaaacatggcacgatgcgtttcctgaagcaagcgccgcatggcccctcttgcccgataatcgggatgcgtacatgcccctgagatatacgaagttgctaccgtctgcccgcaaaaggtcatgggatacggtatcatctgaagtgcggaaatcacctttccgtcttcttctattaccttattaatcccatcggtataacgcagacgaaaatacaaatcgatgaaagcttcgtcatcatcgaagcaggttttccacaactgtctgacttgttctttgatactcattgtaactcaacgatgtatttttcgaggagagtttctggacaataagaaagttttgccttacgcaatccctccagtccgaggtcttcctcccggttaatataaatatattgttctggaatatgaccggcaaattcataattaatcatggcataggctccttcgatatcagtatttgccttctccacacacgtatcgaatgtttcattgttgataggagctccgaaagtaaaggctacgatttttccaccgacatgcagaactcccccctgcaagtcaagctcaccgatatgcttcagcgcatcggtcatggatcggcgttcggcaatcagtgcctcattttcggcacaatcgtttgccttgcaccactcactttccagacggagacactccggaaccaattcaggagtcagctccttgtattcataatccggatatgatgccttgaaccgattgatatggtttcgctttgcctgaaatttctttccacgaagcgtagccagatcggaacggagatacacatagtcgaaatagtcacggtcggcagtaaacgtaaagcgttcgggaaaagcagtttccagttccgcccgcatactgctgcacacgcccaacaaacggaagcgagctcccttgtttcgtgcatcttccatcaacgcctcaataaccttatgtatgtcaccttctcccaccggcatcatgtaagccagttcatcatctgcataaaagcgaaacagcaagaagccgttcaattcagcaatctccgtgcgatacagaaatcgccagctatacaaattggaaaatgagaggtcacagttacgacgcttgctctttaaggtataccgctgtacggtagccttatcttccagttctatgggtttaaatggtatcatattctatttatttataaaatgatgcggcaaaattaaaaaaacgtgccgatatccattcaaaaatatcggcacgttcccatgcaaacatatttgctttaacattcattatttagtacagtcccagcaaatgcaggatagtcggagtcagcaaggcagtcagaataccgttcaacgtcagtcccagactggcataagctccatactttccactcacttccatggcgcgtgaggtaccaacggcatgcgaagcagttcccatcgacaagccttgtgcaataggactacctacacgtcctacctgcaaaaccttgaatccgcagatggcaccaaacaatcctacgacaatcaccacagctgctgtcaatgaaggaatacctcctacagctcccgaaacctccatggcaatcggggtagtcaccgacttcggtgccaaagacatgattacttcaggagaagcccccattactttagctataatcgtaaccgaaaccagtccaaccacacagccagctaattgagaaacaattatcggcatcaattgttttttaatcatacgcaattgtaaatacaaaggtacccccaatgcgacgactgccggcttcagccaaaactctatcagagaaccagcttcagaatatttttcatacgaaatatttgtcagctttaaaaaacaaatcagcaaagctattgctatcaatatcggattgagaatgatcaatcctgttttcttctgcaacagtttggaaagaaagaagaatccaaacgtaatagcaagcagaaagaacttactttctaaatattccatacttacgaaccaattgatgaacccaacctgtaacaactaacactaataccgtactgaccaacgtagcaatcacgataggccagaactcggccgaaatgatgtcgaaatacaacatcaaagctactcccgaaggaacaaagaaaaagcccagatttgcgaccaggaaatcggacaacccctgcacccattgcagtttcacccagcctaactttaaaaataacgtaagcaaaagcatgccgataatactcgacggcagcttaatccccgtcaggtaaacaatcagttcacctaacgctaaacatccaaaaaggatagtacattgacgaatcatacctattacatattaccttgaaaacggctgcaaatttatataataggataaaacgctgtaccgaaagcggcattttttatttcttctgctattaaacataagttttttgcatactttaggagaaaaaaaacacggttttgcaaacttgatattacaaaaatgcgtatttttgcaatgcgatatacattatttgttagcgtacacgataaaagaatcacatatcataaatataattcataaactcatggatttaattagtcaaattgttgaacgcgctaaagcaaacaaacagcgcattgtacttccggaaggaactgaagaacgtactttaaaagctgccaatcagatattgacagatggtgtagccgacctgattctattgggtaacccagatgaaattatgagccttgcaaaagaatggggcttaggaaatatccacaaagctactattatcgatccggaaaatcatccgaagaaagaagaatatgcacaactgctgtgcgaactgcgtaagaagaaaggtatgactatcgaagaagcccgcaagctggttcttaacccgttgtacctgggatgtctgattattaaatcgggcgatgccgacggccagctggcaggtgcgcgtaacacgacaggcgatgtactgcgtcctgcactgcaaatcatcaagacagctccgggcattacttgcgtttcgggtgccatgctgctgctgactcacgctcctgaatgtggtgacaacggtgttctggtaatgggtgacgtagctgttactccggttcccgatgcaaaccaactggctcagattgcaatttgcacagccaagactgcccagtctgttgccggattagacccgcgtgtagcaatgttaagcttctcaacaaaaggttctgctaagcacgaagtagtagacaaagtagtagaagcattgaaacttgctaaagaaatggatccttcattgaagatagacggcgaacttcaggccgatgcagctctggttccaagagtaggtgccagcaaagctccgggttcagaaatcgcaggaagagccaacgtactggttgttccatgtctggaagttggtaacatctcttataaactagttgaacgtctgggacacgctacagcaattggtcctatcctgcaaggtatcgcacgtccggttaacgacttgtcacgcggatgctctgtcgatgacgtatacaagatgatcgccatcacagccaatcaggctattgcagctaaggctcaataaataaccgacttataaacattgtcattcagacgtcattttcgctcgctctgaatgacaactgtttttttattttacacatcaactataacaataaaaaccattatatgaaagtattagtactcaactgcggtagttcatctatcaaatataagttgttcgaaatgactaccaaagaagtcctcgcacaaggaggtatcgaaaaaatcggtctgccgggttctttcctgaagctgactttgccaaacggagaaaagaaaatcctcgaaaaggacgtacccgaacacactaccggcgtacagtttattttcgatacactgactaatgccgaatacggagccgtaaaagatttacatgaaattaaagctgtaggccaccgtgtactgcatggaggtacaaaattcagcggttctgtattgattgacgatgccgttattgcagctgtagaggaatgttgcgacctcggcccgttgcacaaccctgccaacctgaaaggtatttatgccgtacagaaactgttgcctgaagttcctcaggtagccgtattcgatacagctttccatcagactatgcctgattacgcctatctgtatgctataccttataaatatttcgaaaaatatggtatccgccgttacggtttccacggaacttctcaccgctacgtttcgaaacgtgtgtgcgaatttctgggcattccgcaggaaggttctaagatcattacctgccacatcggaaacggtggttctatcgctgctgtaaaagacggcaaatgtatcgatacaacaatgggattgactccgctggaaggtctgatgatgggtacacgtagtggtgacatcgacggtggtgcaatcacttacatcatgaagaaagaaggtctgactccggatgaaatgtctactctgctgaacaagaagagcggtgtactgggtatgttcgaaaaatcaagcgacatgcgtgaactggaagacgcagtagcaagaggagaagaacgtgctatcctgacagaaaacatgtatttctaccgtattaccaaatacatcggtgcatacgcagctgccatggacggtgtagatgttatcttgttcaccggtggtgttggtgaaaatcaggcaacagctcgtgccggtgtttgcaagacactgggttacctgggtgtcaagatcgatccggaaaagaacaaggttcgtggaaaagaagccatcatctcaaccgatgactcaaaagtgaaggttgtagttatcccgaccgatgaggaactgatgattgcaactgatacaatgaacattctgaacgacatgaacaaataaggaagactacccttaaatagcttaaaaaagaggatattccccgtgagttttcttatctttgcagcgagtaaaacgtaaaaagaagacagcttacaagggatatcctctttttttgtgctacttgtctagtcctgaaatagcgttacaacaaaaaaggtaacattatggaaaagacagaaacaaagtacgttaagcgcacacaaaaagattacagtatgtcctttaaactatcagtagtgcaagagtatgaaaccacaaaaataagtttgggagcgctgaaacgaaaatatgggatacaaggatgttcaactattagccgttggattgaaaaatatggtaactttgatatcacaaacaaatgttaccattctatggaaaagagtaaggatcaaaaactgttagaactacaacagaaagtaaggttcctggaacgcaagaatgcccgtctggaaaaggagcttgagctgaaggatatgaaagcagagtttttcgacatgatgatagacatagcggaaaaggaatataatatcgacatacgaaaaaactcctctcccgaacagtcaataaatataaagaagaaaaatccgtaagtatcagcggaatctgccgactgctcgggataagcaggcagaaatattaccgtcagcaatggaagataatccgaggccggcaaagggccactgatgttgtgggcatggtacgagatatccgaatggaactgccacgtgtaggaacccgcaaactttatcatatgcttcatcagccacttaaggagaacaaggtaggcagggacaaactgttcgatatactccgtgccaaccgtctgcttataaagcccgtacgttcatatcatgtaacaaccaactcgcatcaccggtttcggaagcacaagaatcttgtagaaagtatggaagcgacacgcccggaagaaatatgggtttctgatattacttatattggcaatagaaaccggcatatgtatctttctctggttacagatgcttattccaagaagattatgggatatgatctttccgattccttggacactcaaggttctttgaacgcgctgaggatggcaaaccgcaaccgactgtatagggacacgccattgatacaccactctgaccgtggtatacagtactgttccgatgcatatcagaaattactgggacaatatcacatcatacccagcatgactgaatcttacgatccgtacgctaatgccgtggcagaacgaataaacggaatactaaaacaggagttcctgcttgaggaacttaatctaccgctatcagatatgaaacaggtaataagggatgctgtctacaagtataataacatcagacctcattactcttgtgggtataaaacgccggagtatatgcatcatcagaagctgattaaaattaaaagttacaaaaacaaacagttcagcaagactgaccttgctgaactgtgataaataatttatttttgtccaataactgtaacggttatttaggactagtcaactcagacaacaagaaacactcctttattatgaaaaagaaaatcgtaacctttggcgaaattatgcttcgcctgactacccccgacaatctacgtatgcagcaaagccgggaatttttggttaattacggtggcagtgaagccaatgtagctatctccatagccaatttcggcggagatgtagaatatattacccgccttcccgacaacgccctgggagaaacttgtctggcagaattacgctcgcacaatatcggcacccagcacattctgataggcggacaccgactgggaacctattacatggaaaaagcagctgccatgcgtaactcaaaagtcatctacgaccgtgaaggttctgctttctccgaactgaaaccgggtatgatagactggcgcaccatctttagcgacgcagctattttccactggtcgggcatcgatgccgcactgactcccggactggcagaggtatgcaaggaagcaataaccattgccaaagaaatgggactgaccatttcgtacgacatcaattaccgcaagaacctctggaactacggaaaaagcgcacaggaagtgcttcgtccactgatggtaaacagtgatatcatgttcggtagcgaaggcgaatatgccctgctgacaggtattccggcaccgggtttcaaggctaccaagagtggagaaacatacgatataaaagcatacgaggaattttgtaaggctatcagccagcagattccaaactgcaaatatatctatattgccctgcgcaacgtcatgagttccgagcatcacactttcgctggagttctttactcgcacggcaccatgaaatatacacgtgtattcgatatcgacaacgtaatcgactgtgtaggtgtgggtgatgccttctgcggcgccatgctgtatgcccagcacgcttacgaagacgaacagaaacgtgtagatttttcaacagccgcttcggttttgaaaaacaccattgccggagactataacatcgtaaaggtatccgaagtagaaggattgctggcaaaacacgaaagtggagaagtagcccgataaagcaacgtacatacatttacgatacacatttatacacaataaaagaaccatatcacgactcattagcagagtttgatatggttctttcacgttaaccagcaatgttctggtatccttttatcgcacagaagtctctccttcgatatattgttccaggaacatagactccccgtcgaatacagcatacgaaaattcactgatccagtcacccagaatcatcatccgcgatgaacggctcagcatcaggtcgagtacgatgtgacgatgtccatagataaaataattaatgtcgggatgcgttttcagatattccttggtaaacaataccagcggttccttatcttcgcccatatattccggttcctttccgtccttccgtttcatacggctatgctttgcccactccagtccgaagtcgatactccagcggggatgcagcatggaaaacagacgttgcagcgttttactatgaaacatagcacgcagcaacttaaacttatggtcattatcacccagcccgtcgccatgcgccaggaaaaactccttgccataaatctcacacgtcagcggttcacgatggataataaccccacattccttttccagataatcgccgcaccagatatcatggttgccgataaagaaatgcacctctactcccatatccgtcaactcagagatttttcccaagaaacgggtatatccttttggaacgaccagcttgaattcataccagaaatcgaacatgtcgcccagcaaatatacggctgccgcctgatgcttgatactgtcgagaaagttaaccagccggcgttcctgcgtacgactatgctctatcgcacgtgagcccagatgagcatccgacagaaaatagacattcttcatcgcttccataaccattcttttttataggaatcccagttccagtttggcttcttctgtcatcatgtccttatcccattcaggttcgaacaccagattgatttgagcagccttcacaccttctaccgattctattttctgacgaatatcttccatgataaaatcggcagccggacaattgggagccgttagtgtcatatcaatcaccacctcaccatcgtccttcaaatctatcttatatatcaaacctaaatcgtatacgttgaccggtatttccggatcgtatacggttttcagcatttctacaataccttcttctattttcagttttgtttcgttatccataaaaagcatgcttttagttacatctgcaaatgtaataaaaaaatggaataaccgaaaaacagtcacaaccttccctcgtcgcaataactgtaataatccccgtcggttaccaccagatgatcgagcaggcggatattcatcaactcggcagcacgccgtacagcctccgtcagccggtcgtcgtcacggctgggagaggtgtttcccgaaggatggttatgacaaagcaccatcgataccgcacgtttcaacaaagcttcacgcaaaatacagcggacatccacctgtgtggaagccagtccgccatgactgatacgaatacggtcaatcaccttcgacgactggttgagcaacaacacccaacactcctccaccgggaggtcacacatcagcggataaaacacttcgtatatgtctttggaacatctcacctgccgacgttccaaaggctcttcctccatccggcgcctgccaatctccgaagcggctaaaatcgtaaccgcctttgccggccctattcccttgtagcggcaaagttcctcgatagtagtcttccccaattcacccaagctgttgcgataattccctaagattttccgcatcagttctaccgccgagtcctccgtattgcccgaaccgatcaggatagccagcagttcggcattcgacaacgccgcagcaccatgctgcatcattttctcacgcgggcggtcttcttccgcccattggttgatagtcagtttattttccatttactcataaaagttcttctcgaaggcggaaaaagctcccttgccccgcacacagcgtttccaccatgcagacaagaagccggttccataccccgtcaactgtataaacgcagcaacgacggataatataccgatatacaaacttttattttgtatggaagaatcaataaatataatcacagcaaacaaggcaagcagcaaaagtacccacggacataccagcgaagcgagcagcaccagcaccacacctaccgtaaaaacggcaggaagcatgtgtaccagtttcagcgattccgggtatttcttatacagattgatacgtgcgatgcccgaattgtgcacctgtttgaagaacttcttcaggtcggtacgacgcttgtgccatacccatgcttcgggaaacaaacggcaacgataccctcctttaaagatacggatgctgaaatcgatgtcttcgccaaaacgcatcttcgagaaacctcccagcgcacgatagacctcggcacgcacgcccatgttgaaactgcgcggataaaacttatccattttcttcttccccccgcggatgcctcctgtagtgaagaaagaagtcatggcatagttgattgccttttgggtaggcgagaaagaatcgtgtgcacggtccggtccgccgaaagcatcggcaggctcacgcttcagctcttcgtcgacggcagccagataacccggcggcagcacacaatccgaatccagaatgagcagatactctccccgactacgttcagccccgaagttgcgggtctgccccggtccggagttaggcttattataataatgtacatccagttgcgtacggtatttctccacgacctgttcgcaaggcacggacgatccgtcttccacaaccagcacttcaaaatcatccagcgtctgttccgtcaggctttgcagcagctcatccacctcatcgggacgattgtatacgggaataataaaagaatatctcatagtctgttcgttcggtttattttacaaagatacgtctttcttgaaagtatgctgaactttgacggagtttcttcaacattttccgcatacacaacgaacggtttctgaaagcctgccgggtcccgaatattttttgtacaaagtttttttgattttgtacaaaaaataaaaaaacgtcccgacattttccggcaaagacaacggacagccgacaacatcgccagcaagcgcttccgtcggcaaccagcaatctgttttccccatcttcggcgaggaaaaaaggaaaaaagaagaaatttttattctttccttgttacaaaacatatagctttacgtttacctttttgaaaacaattcgtacgacccgattaacaaagcatgagtaaagaaacactgacatcgactttcaccgaactgagaaacggttttctcagactggccatgcgcttcctgcccaataaggaggatgccgacgatgcactacaggaggcattctttcgtctgtggaagcatgctgatcagatcggttcgcgcgaagaagcagaagccctcacggtagtcacggtaaagaatctgtgcatcgataccttgcgcaagaagaatcaccagcctacggtggaactggacgagaaccgggatgattccatctccgattcggcagccgacagtctggagaaagaagaacgattccgcatggtggaacgtatcattgaactccggctgacacctctccagcagcagattctgcacatgaaggaatacgacgggaagacgtacagcgaaatagccgaaagtctgggcatgcaggaacctgccgtacgcatgcaactgtcgagagcgagaaaagaaatcagggaatgttacttaaaacaaatggaacgatgaaagaatacgaacggacttttcaacagtggaaggagctggcggcacggtattttgaagctgaaacgaccgatgcggaagaggaagcattggcgcgttttctggctactccagccgcacagggcaaagagttcgacgaacttcgtgccgtcatgggatatgtcgctaccggacgagccgtataccgcaagcagcggacacgcagcatacggttgtggtactatgcggcagcagcggcaattgcagccattctggtgatggtaaccgcctggcagtggacggaaagggcgaacgtatgcgtggcctacatcaacggcgaacgctgtaccgacaaggaaatcgtattggccgaggccctgaaatcggtacaaaaggtacgccacgattcccccgaagaaacccttcaggggcagttatcggatatcttccagacgctggaggaaggagaatctgcatcagttgacaatcaaaaataacaagctatatgatcagacgatggattataatatggatgaccttgctgattgcactgcctctgtgggcacagaagggtatgcatgtagagtccctgttcggcggacgcttcaagcaagacaaacgggcggtagaggttcttatcaaaggtaaggaactgaaaaagtaccatctgacgcttttccgcagcctgacggtgaccgatgctccggcattgtcggaagaaatcgaagcactcgtcagccaggatgccgcatcggccgtcgacaaggaggtgggaacggtaggaaaacggctctactatggtttctactgctttccggcacgagatgaaagtttccggtatctgttctaccggaatacagcggtagcccccagcggcagcaagaaaccggaagtgactgtggtatacatggaaggacgggttacgctggaagagctgaaacaactgttcaaataaaatgataattcataatacaactgaaaatatgagaaaaatatttttgctggcaggactcctgctggctgcggcaaacggctatgccgaaagtacagactcgctgaaagtagaaagtgtagtaagtgtggaaaatccggaacgagtaaccattacggaatcagacaatcgtttcaaggtcgaaatagagggtaagaagggaaatcctaacttccgttatacccgtgatgtggaattatctccttcggaagtttccgttaccaaggaacgcagcagcaactgggatttcaacattccgttcaaaaaacgtacatcggccaagagaaacaagcagaatgaatttcaggtaaaagacttcaagataggactttccagcgtacaaggagcccccaacggcatggatgtgaacatgggctcatcgtgggaaatcaccactcctaccttcggatgggcctattatccgtggaatacggaaacctccctctccatcggagtggcatgcagctggcgtaactaccggatgacaggcaagcagcgtttcataaaagatgcaggaaccgatatgtacatcggcagttatccggaaggagccgacattcagttctcacgtatcaaggtattcagttgggcgattcccatcatgtttactcatgaaaccaagaataacttcaacttcagcgtaggagccatcgtcaatttcaatacgcatgccagcctgaaaacgcggtataagctggaaggacaggcatataaactaaccgacaacaacattcaccagactccggttacagtcgatattcaggcttccataggctataagtctgtaggattctatgtaaaatacagcccgtgcaaggtactcgatacagcatacggccccgagtttacggcattgtcggtagggattgtcctgttctgacgatgaaccggcagcaaacaaaagagccattcctgtttccatgcaggaatggctctttacctattatatatatcagtctgataaattatgcttttacacgacctacgtaagaaccatcgcgagtatcaacttcgatgatttcgtcctgattgatgaacaaaggcacacgtacagtagcacctgtttcaacagtagcaggcttagtagcgtttgtagcagtatcgcctttcagtcccggttctgtgtaagtaaccttcaactgaaccttaaccggcaattcagcgaacaagatagtttcagtagaagcatcagatacaacgtctactaccatttcttctttcaggaagtcaacaccttcgatcagatcgtgagcgataggcacttgttcgtatgtttcctggttcatgaagatataatcttcaccttccttgtacaaatactggtacggacggcgttctacacgtacatcttccagtttttcaccgatgttgaaacgacgttccaaaacgtagccgtctacaacatctttcagttttgtacgcatgaaggtgtttcctttacccggttttacatgcaaaaagtcgatacagaaatacagctttccatccatacggatagctgttccgatcttaatgtcttgagcattaatcataattaaatccttttattattatatattattgattgttgcgtaataattcgactgcaaaattaatctaaatcacgaaaaaacgcaaaaagatttgtctaaaaatgatttagctattggtttatttaaaaaaagtcactaattttgcagcccgaacgcatagaataataacataaatagtatatacgaaaatgaaaagaacttaccaaccctctaacagaaagagaagaaacaaacacggtttccgcgaaagaatggcaactgcaaacggtcgccgagtattggctgcacgtcgtgctaaaggtcgtaaaaaactgactatatcagacgaatacaacggcgtaaaagcataagaacgttagacagaaagatttaagagagccgcaagatgctgagatagcgttttgcggcttttctttttacaaagcatagcggaaaagaaaaaattgtatctttgcaaaaattatatagctgaataatatggtgacactgaaagatttcttttcattcaagaataaccgtttcttctggctcaacatcatcggtatggtggtagccattgttgttatcgtgtacggtacgttgtggggacttgatatttacactcaccacggagaatcgtatgtagtgcccaacattaagaataaggagttaagccaggcgcagatattgctgagccagcaatccatgcaaggtgtagtaatagattcgagttatgtaaaggaactgcccgcgggcatcgttctcgaccagactccggcaggaggtatgcgggtaaagaagggaagaaccatctacctgaccatcaacaccaacgaggtgcccagggtgaaaattcccgatgtcatcgacaacagctccatgcgtcaggctgccgccaagctgaaagccatgggattccggctgacggaacccgaaatggtagcgggagaacaggactgggtatacggcatcaagtatagaggacgttcgctgaaggcaggcgacaaagtaccgagcgaagctctgctgacactgtgcatcggcagtacgcaaatacgtgattcactgagcatggactcactcaacatgcagatagaaatggatgcagcgggagaagaggctcctactgtagacgattcgtggttctaaaagattcaacaagttcaagacaacgaatggcagaagattatataaacgaactggacgactcgctggatgatgtagagccggtagagcgttcctccgaattatacgaacatttccgtgtagtagtagataaaggacagacaccggtgcgcatcgacaagtatctgttcgaacgcatcgtcaacgcttcgcgcaaccgtattcaggcggcggccgacgcaggatttgtcatggcaaacggcaagccggtaaaaagcagctacaaggtaaagccgctcgacgtgctgaccgtcatgatggaccgtccacgctacgacaacgatattattcccgaagatattccgctggacattgtttacgaggatgatgatctgatggtcatcaacaagcccgcaggactggtagtacatccggggtgcggaaattatcatggcacgctggtgaatgccattgcctggcatctgcgtgacgtaccttcctacgatccaaacgacccgcaggtgggactggttcaccgtatcgacaaggatacctcgggactgctggttgtggccaagactcccgatgcgaaaaccagcctgggattgcagttctacaacaagaccaccaagcgcaaatacaatgcactggtgtggggcattatcgatgaagacgaaggtaccatcaccggaaatatcggacgcaaccccaaagaccgcatgcagatggctgtcatgagcgatcctacgcaaggtaagcatgccgtaacccattatcaggtactggagcgtctgggctatgtcacgctggtaaagtgtgtgctggaaaccggacgtacccatcagattcgtgtacacatgaagcacatcggacacgtattgttcaacgatgagcgttacggtggtcacgaaatactgaaaggtactcacttcagcaaatacaaacaatttgtaaacaactgcttcgagatttgtccccgtcaggcacttcacgccaaaacgctgggatttgttcatccgcgtacaggcaaagagatgttctttacatccgaattgcccgaagacatgacccgtctgctggacaaatggagaacatatataagtaacagagaagaataacaaacaaattatgaaacgcatcattgctattgttgccggaggagattcttcggaacatgatgtctccatgcgtagcgcagaaggcatatactcttttatcgacaaagataagtacaccttatatatagtagagctcaccaagaaaaaatgggaggctttgttgcccgacggcagtcgtgcaccgatagacaagaacgatttcagcttcagtcacgacggacagaaggtgaaacccgactttgcatacattaccatccacggcactccgggagaaaatggtattctgcaaggatatttcgaactgctgggtatcccctactctacttgcgacgtgctggtttcggccatgacattcagcaaattcacactgaaccagtacctgaaaggtttcggtgtacgtgtagccgaatcgctgctggtaaacaaacgtcacggcataagcgatcaggatgtcatcgagaaaattggtcttccttgctttatcaagcctaatgccagcggctccagctttggagtaacaaaggtaaagacggccgaccagatacagcctgctctgaaagaggcctttgccgaatcggacgatgtcatgatcgaggctttcatggatggtattgaacttgccaacggctgctacaagaccaaagacaagtcggttgttcttcctatcactgaggttgtcagcaaaaatgaattcttcgactataatgctaaatataaaggtgaggtgactgaaatcactccggcacgcctcagcccggaactgaccgaccgtgtacagaaactgacttcggctatctacgacatactgggatgcaagggtattgtacgcgtggactacatcatcacgaaaggagaaaaaatcaatatgctggaaatcaataccactccgggtatgacagctaccagcttcatcccgcagcaggttcgtgccgcaggcattgacatcaaggatgccatgacagatattatcgaagattcatttcaaaaataattgaaaattccgtatatttgaacattgacttataaaacagataaccatgaatatacctgccgagtttgacgaaatccgtccctattctcccgaagagcttccacagatcttcaaggagttgttagccgatccctcatttcaggcagtgctgacaaatatcattcccggggtacctgttgaaatgcttgctgcaaagctgtatcaatgtaagacgaatctggatgtacagaagacatttttccacaaactgctccacgatatcatcgacaagtacagcgatggtttcgacatggacacatcttcgctgagtgacaagaaccggaattatactttcgtttcgaatcaccgcgacattgtactcgatccgggattcctgtcggttggacttttggataatcattttccgacaactgtagaaattgccatcggcgataatctgctgatcttcccatggatcaagaaactggtacgtataaacaaggcattcatcgtacagcgtgccctgtcgatgcgccagatgctggaatcatcggcacgtatgtcgcgttacattcattttgcaattacgcaaaagaaagaaaacgtatggattgcccaacgggaaggaagagccaaagactcgaacgaccgtacgcaggacagtgtactgaaaatgcttgccatggcgggtgaaggggatgtcatcgaccgtttgaaagagctgaacatcgtccctactgccttgtcgtatgagtacgatccgtgcgattatctgaaagcgcaggagatgcagcagaagcgtgatatcgaagggttcaagaaaagtcaggaagacgacttgaacaatatgcagacaggtatcttcggatacaagggaagagtacatttccagactgctccgtgcatcaacgaagaactggaagccttgcgaggactccccaaaacggaagtattctccagaatatccgaactgattgatgtgcatatccaccgcaattaccgtatctatccgggaaattatgtggcatgcgatctgctggaaggcggacaaacttttgccagtcattatacaaacgacgataaggtacgcttcgaaacttacgtgcagaagaaactggatatgattcagttgcccaacaaggacgaagccttcctgcgccgttgcatactgacaatgtatgccaatccggcactcaatcaccagaaagctctgaacgtatgaaacaagcgatagcaatggtccttcttctttgcatgcttctttgggaaggatgcaaggaggaagactatgtataccctagtgtggtaaccgaatttatcggtgcgcagaccgattcggacggaaccatctcacaactggttgcagataacggaaccgtatatcctgtgcttcagcgtgacggtctgggaggactggtagccgatacactctatcgtacaatatccatttacgggcccctgccacaggaggatggcaaggaaactgctgctcagctgtattcatgtcagcttgttctgtcgatgaatccactcgcagaaaaagcttttaagggacaaatcaaaacagatcctgtagatatacagagcatctggctgtcgggcaattacgtgaatatgatactgctggtgcaatataaggaccagactcatgcatatcatttcatcgatgaaggcttcaccgccaacgaagacggtacaaggacactgaacctgcgcttgtatcacgaccggaaaaacgattatgaagcgtttaccaaacaggtctatttatcggttccactcaaaaaatacctgcaatcgctgcaaaaaggcgataaaatccgcttctacctcaatacgtacaaggaacaagaaacctatcgggaatttgattaccaataaacagcaaccattatgataaagagcatttactttatgttttttgtatgcgcctgccttttcgggctgttcgcatgcagtgccaaagcacaagataaattcaaaaatctatcttctgatgactttgagaagctgatacaggacgaagacattcaacgggtagacgtacgaaccgtagccgaatacagtcagggtcatattccgggaagcctgaatatcaatgtactggacgaaaagtttgctgcggaagcagatgaactgctcgacaaggaacgtccggtagccgtgtactgcaaaagtggaagaagaagccgcaacgcagcacgtatcttgactaaaaaaggatttaaggtttacaacctggataaaggattcgaaaactggaaggaatctggtaaagacatcgaactctaaaaaatacacatgcggacatttacgtggaaattctgaagtttccacaaaatgtccgcatgttttttatgataaaaatcgaattatttcaacgactgaagcatacgtttcaatacaacagtagccgaaatttcgcgattggctgcttccggaataaccagcgaagtaggtgcttctatcacatcatctgtcacaatcatgttacgacgaaccggtaggcagtgcataaagtaagcattgtttgttacagccatgtgagcagtatctaccgtccagctcatatccttactcagaatcttaccgtagtcggcaggatttgtcactcccggacaagcccagttcttggcataaataaaatctgccccttcgaaagccttcatctgatcgtattctacatgtgctccacgtacaaatttcggatcaagttcataacctttaggatgagtgatcacaaaatctacatccgcttcattcataaaatcggcaaatgaattaggaacagcctgtggcagtgcacgcggatgaggagcccatgtcaatacaactttcggacgttctttctttttgtactcttcaatggtaatcaagtcggcaaatgcctgcaacggatgtccggttgccgcttccatcgaaaacaccggtttgccggaatactgaataaactgattcagaattttttctgtataatcgtcttcacggctttcgaaacgggcaaacgaacgcacaccgatgatgtcacaataagaagccatcacaggaatggcctcaagcagatgttcactcttgtcaccatccatcacgacaccacgttctgtttccagcttccaggctccctgattcacgtcgagcacaatcacatccatgcctaaattacgtgctgctttctgcgtactaaggcgggtacgcaagctgttgttaaagaaaatcagcaaacaagtgcgatgcttgcccagagattcatatttataacggtcctgctttatttcgaaagcttccgcaagggcggtcttcaaatcacccagatcgaatacattggtataggttttcatacgatctattgtatataaattaatattagtacggcaaatatactataaaaatgcaagactatagtatatcagaccggattcttgcaaaaatattctatttacggatttgtccgttaccttcaatcagccacttataagtagttatttcccgcaatcccatcggtccgcgtgcatgtaatttctgggtactgatacctatttcagctcccagtccaaactgtgcaccgtctgtaaatgaggtaggtgcattggtatacacacaagccgcatcgaccatggcacaaaaataaccggcagcctttttatcttcggcaacaatacattcgctatgtttcgaaccgtatgtataaatatgcgatacagcttcctctatatcggctaccgtccgtattgccattttataatcgagaaactctgttccgtaactgtcggctgtagcccgacaaagcaattccgacggatagtggccctccaatgctttataagcaacctcatcggcataaatcgtaaccttactatcttgaagaggagtacataaagcaggtaaatctgccagtcgtgatgcatgaatcagcagacagtcgagtgcattgcatacgctgacacgacgggtcttggcgttattgacgatagcagcccctttcacgatatcgcccgaagcatcgaaataagtatggcaaacaccggctcccgtttctataaccggaatggtggcctcccgacgtacatagttaatcaggttgctgctgccacgcggaatgatcaaatcgaccaacccttcggcatggagtaattcggctgttgcctcacgactggcaggcagtaactctacaacatgcgtatcgactcccagttgtgacaagacttcgtgtatcacttttactattgcccgattcgaacagtcggcatcgcttccacctttcagcacacacgcattaccacttttcaggcaaagcgaaaagacatcgaagctgacattgggacgtgcctcataaataataccgataactccgaaaggaacacttactttcttcagatgcaacccgttcggacgaacggtttcctccaagattctgccaagcggagaaggcagagctgccacattccgcatatcggatgcaattccttccagacgttcttccgtcagcttcagcctgtcgtacttcgggtttgcaggatccatccgctgaaggtcctccctgttagcctccaatatttttttactatgcttcacggctgcatctgcaactgcaaacaatacctcgtttatctgtttttcgtccaacaatgccagccggcgggaagcctgacggacatcgtgtaaaacttcatttatattcatacgactatttgttacacaatacaatgattccctgcaaaaatatcattatttccatgatttcaattctttttttatttttatataaggatattacgaaaactttcttatctttggataaacatacagagagtatcaaccctttttattaaccactaaaacaatgagctatggaaactaaaacgtatggatcactggtagaagttttcagaggcagtctctgggaagcagaattaataaaaggtttgttagaatcagccggagtgtcagctatgctgaaagatgaaacattatcagctgttacctctccttacttaccaacaggagatgtactggtaatggttaataaagaggaagaagtttatgctaaaaaagtagtatcagaaagaaaagtatgagaaaaaagatctttgcagcgatggctgttctggctcttacagcattcagtacgaatgcacaaacattaaaatcgaccacatggaaagcctacggggttagttttaaagctcccgcaggctttaatgtagaggatgattcagaagaaggatacattatcagtacgccaacctattacatcacggtacagcttctggaaggagaaggtatccagcgctcggaactttcgcaagagctgaaaaatattgcaactgacgatgaagtgactaatcaatcgcctgttaccactttcgaacttcctcagttttatggtgcgcaactgaaaggaaactgtgaaaccgaacagtgtgtctattcttatttgttgagcaaagacggaagcagtggattttacgtgtccattacttacacagacaagaaagacaatactcccgaagccattctgaaaagctttacactggaggaataagatgccgcagtgaaagggaatgataaaagatacgatataatgaaacaacctataccaacctatacttccattcgctggtggaacgccttgtttttattggcgattttattgccaatgggagttttgccagccacagcacaagatatcagtgaaacaactgccctgacttatagctgtcaggatattcccaaaagcattactttctgcggggagaacattgatctgacccgattcgacaggcgtgaacgtatcgaccgtgaattactggctttcacgtatatgcacagtacctccatccaaatgatcaagcgtgccaaccggtatttcccgatagtggaatccattttgcgtgaaaacgggattcccgacgatttcaaatacctgatgtcgatagaaagtaataataacccactggcgcgttcgggagccggagctgccggactttggcaactaatgcccggtacagcgcgtgactttggcctggaagtaggacacagtgtagacgaacggtatcatgtagagaagtctacacaagcggcctgtaaatatcttaagcaagcttatgcccgcttcggaaactggaccagtgtagccgcatcctataatgctggtcagggacgtatctcccgcgaactggaacgtcagtacgaagagaatgcactcgacctccagcttgtagaagaaacggcacgttacgtctatcgtatcttggccgctaagattatgtttgccaatccgcaaaaattcggtttccggttgcgtgcatgcgacttatatccggttattccttaccatgaaataaaggtagaagagagcattgaggatcttccccgctttgcgaagggaagaggcatcacttattcgcttttacgaaacatgaatccatggatacgtagtcattcacttccggtacacggaaagcaggtgtattatattcgcatcccagacaaagaagaaatgtactataatccacgggtaattattgcacacgagccgaactgggtagtgaaagaaaaataagattcacgacgtatatacgattacagactttcaaaatctcaattttaagagaatagactttaacattcaacatttttataaccaaaaagaaagggccgtatcaatacttcaaacagaagcttgatacggcccttttttagtctcgtagttacaatcaattatcgaagggaggtaacatcaatctagtgccgccacactctttgtttataacgaaccggaactttcctcaccagtctatttcctttaatcctttactccgcaagtattcatttgctttactgaaatgcttgcaaccaaagaaaccataatcggcagacctcggagagggatgaactgttgtcagaatgcaatgcttggttgcatcgataagggaagcttttgccttggcataacttccccatagcataaagaccaggttctcgcgctcgtcgctcaatttcttgatgacagcatcggtaaatgtttcccatcctctgttacggtgagaacccgtctgataagccctgaccgtaagtacggagttcattgaaaaaactccttgttccacccatctatccaaattaccggacgaaggaataggtttacccaaatcttgatgaatttccttgaagatattcatcaacgatgccggaatagccgtaccttcgggtacagaaaagcaaacaccgtaatacagtcccggcgtaggataagggtcctgccccaagatgacaaccttaaccttttcaaacggacatgcgttgaacatatggaatatctgtgaaccttgaggcaagacatgttcatgcgcatactcatagcgtacaaaatctgtcagctgcttgaagtaaggcttatcgaactcttcctgcaaacggcagcgccaactttcttctatcttgacattcatcttttttatattacttgcttcaactgcaacctatcgctgtggaatatcggccgatgtttcacattttcctttcaggtatttggagaagaaatcaaccagacgccagtagaaatactcattcatatctccaaacccgtggcgctgtcccggtaatatcaacatttcaaaacgcttgttggcacggatcaaggcatcgactacacggatggtattggctggatgcacattattgtctatatctccatgtaccagcatcaaatgccctttcaactgtttcacgatttcaggattcgttgcaattttataagcaaaggttgtatcgcctttctccgaaacttcttctttcacgccatgatgcgtttcactccaccagcggttataaatccggttatcgtgatttccggcacacgatacggctgccttatagaaatcgggatactgacagatagctgctgtcgacataaatcctccacccgaatgtccatgaataccaaccttgtctatatcgataaacttatagcgtgctgccaactgttccacggctgctttatgatcggcaagtggataatcgcgcatatttccatatccgtagttgtgataccatttcgaacggctgggatgaccacctcgctgtcctacggaaataacaatgaaaccagcctgtgccaaacggtcggtacggacactcatacgggtaaacggataataaacggcttctacctgaggacccggatatacataatcgataataggataaaccttcgttgaatcgaaattataaggcttatacatcactccatacagatctgtcactccatcggcagcctttacggtaaagagctccgggaactgataaccggcagctttcaactgtgagaaatcactctcctgaatagtcataaccttattcccattgcggtctatcaaatcagcacatggaatagtgtttacccgtgaataattatcgacaatgaagcgagcttcatcgtcaacttctacctcatggaagaaattacccttggtcagcaacttcaatccactgccatcggcattcaccttatacaaatgttcataataaggattctctccttcctcacgaccattggcgataaaataaatcgtgcgagcaggttcatctacctttacgacacgttctacatgccacggacctttagtaatacgattcttcaaattgccgcggtcgtcatataaataaaggtgtgcccagccgtcgcgttcgctccactggataaattccttacctccattaaatacgtaaatcggacgagtttcctgatacgtattcatacgctcctttacaaccggcacaatggagtcctgtccgatagtataggtacatacatcaatacgatgcaagtcacgactgctgcgagtcaggaagaaacgagtgttatcaccttgccatataggagagatgaactccgcatcacgttgtttctgctcgtaaggacgtgcttccagtcccagactctggttcttccaggcagccactttaatctccttacgcttattgtctgtcatatcgaacagatacaaatgctcttcgggagcctccatttctcccggcatctggtaacggtacgtttcaagtgtaggacgaggttgagcaaccgaattgattacccaaaggtcttttaccttgcggtcgtcggatacgatcgttacaaaatgcttcgaatcgggcgaccagtatccccatacactgcgacgctttccgttacataaggtatcggtattcaaagtactataaggaatgccatatccaaaatgctcggtgccatccttcgtcaactgtatctcgacaatcgtactatccttttcgtctttttgtgccttccggtaatcttccatactcatccggtacaaattacagtctttcgcataaacgacagttttaccatcgggagaaacagaagcccactccagtttcttcggttcctttgcctcttctgtcagctgggtaagtttacgtgtgggataatcatacgagaaataaaaaataaccttttcggcctttttcttctcttctttcttcggcttagcctcctgagaagactccacctcaaacgtaaatgtccgtccgtcttccttcgccttcagattacgaatcggtaaatgacgtgcttcgaacggatcgtgtacgatttccgtcaactgggaagccagttcatcacgatcgaacaacagcttttttgttttagcagccggatcaaccacataccaaaatgtaccttcgctggtcttatattcgaaccagaaattattacctttctgaaaccagtgcggatcgaccgtagtggagaaaagcattgtattcaacttactttgagtaaatttttcagcctgaagatattcaggcaatctttcctgtgcaggcagtgtttcaggaagcaaacacatccctcccacaaacataaccgtaaaaattaactttttcataactcctttatacaaaaaagcactgactatatcatctcccagagaagagtaatataatcagtgcatttacttattatcaattagaacagaaatcttagtacatcgttgaaatttgcccaaatcagtaaagcaaaaagaaggaacattcccaccatctgagcatactccaagaacttgtcactcggcttacgacgggctataatctcatacaacaagaacaagacatgaccaccatcgagtgcaggaatcggcaaaatgttcataaaggctaagataatagaaaggaatgccgtcatctcccagaaacgctgccagtcccataccttcgggaagatacttccaatcgtaccaaatcctccgacgctcttggctccttctttcgtaaacacatatttcatgtcgtttacataaccttttaaggtatttacccccaaagttactcctgccgggaatgattcaaagaatccatagctcaaattggtttccttataatcaactatacctccaatggcatcgaccataaactgctcatttgtctgaaccgctaccgtatctctcactccctgacgagaatagaccaaagtgaactgtgccgatgttttcttttccagttcagccttggtgcgaagcttactcatctcgtccaaaaattcattccacgaattcaatggagtaccgttgaaagcaatcagtgaatcgcctttctgaattccgaccttagcaaatcctccaccagccaatacagaatcgacgacattcggacggaaggtagcaacaaacatcggatcctctttcgccacatcaatcaagctcagctccggcatcaggattttcttttcctctccgtttcgaaggacggtcacttcacgtgcttccacaatattacgaagcatatccatatcgaaacgaaccagttccttgccatcggcgcttttcaagatatctccatcgcggaaaccgatcttctgggctgtctcgttgaatttcataccataggtcatatccttcaaggctacataagaatctccccatgtataaagaatcatcgaatagataaacaaggccaaaaggaagttcatcagcactcccccaaccataaccagtaaccgttgccacgccggtttggaacgaaactcccacggttgcgccggttgcttcatttgttcggtatccatcgactcatcaatcatacccgatattttacaatatccacccagcggcaaccagcctaccccatattccgtatcactgtttttcggcttaaacttaaacagtgaaaaccaagggtcgaaaaagatataaaacttctccactcgtattttgaaaagacgggcaaagaaaaagtgtcctccttcatgaataatcaccagcagtgacaaactgaggatcagttgaagggcacgaatcaaaaatgtttccatctaaagtttattttctatttttaaattaatacattctgttacttcattccatttataaccatttcagccgcaatacgacgtgtttccgcatcggtagaaacataatcctcgtaagtaggagtcgcaataaaagacacacgctgcatcgccttttcaattacatcactcataccaaggaaagatatctgatctttcaggaaagaggctaccaccacttcattggccgcattgacaatacaaggcatattacctccctgatgcaaagcttcataagccaatgccagattgcggaagcgcttagtatcgggagcctcgaaagtcaggctgttacacttcaggaagtccagacggtcgaaagaggaacgaacacgtttgggatatgaaaaggcatactgaataggtaaacgcatatcgggtactcccaactgtgctttcacggcaccgtcttcaaattctaccatcgaatgaataaccgactgaggatgaacgacgacctctatctgatccggacgtactccgaataaccattttgcctcaataacttcaaaccctttattcatcatcgaagccgagtcaatcgtgatcttcgctcccatactccagttaggatgcttcaaagcctgttctttcgtaacatattgcaattgctccattgtaaacgtacggaaaggtccgcccgatgctgtaagaataactttttccaatgggttattcatctctaaacactggaaaatagccgaatgttcagaatcgacaggcaggataggagtatgatattcgtttgccaaagcatttatcaactcacctgcaacaaccatcgtttctttattggcaagggctataattttaccggcacgaatcgcactcatcgtcggacgcaatccggcataccccatcattgccgtcaatacaatgtcgataggttgtgactccacaacctggcaaatagcatctgccccagcataaaccttgataggcaagtcagataatgcctctttcagttgcaaatacttatcttcattggcaatcacgactgcttcaggatgaaacttccgtgcctgctcaaccagtaaatccactttattattagcggtcaatacataagcttcatataaatcgggatgctcttctatgacttgcaaagcctgtgtcccgatagagcccgtagaacctaatattgcaatttgttttttcatatactaaaatacaacgtatttttcaggattagtcggattacctctatgccataactcaaaatgtaaatgaggctgatcgccatcttccgtcgactttccaaccaacgcaataacctctccaccttttacttgttcaccttcccgcttcatcagagaaccacaatgcttatacacggaaatgaaattctgcggatgttgtatctgaatgacatatccccattcagctgtataagcagccataataaccgttccatccaaagctgcaagaatgctttcgttaggacttgctgtaagatctataccaaaatgtcgcttttccggattaaagcctgcggacatgactccacgtaaaggacgatagaaaattaatccggcagcatcgcgcacgtccgttacagcagtcagattatatctttccttttcttcatattgcttacgaaattcttcttctttcttcgagcgttccatcagtttctccgcacgaaggttagtcagcgagtctatcgactgcaccgtatcagcctttacctgtccgctcaagatatcctgaatattcatgacataccggctctgacgttcgagcgccgcctgcaaggaatccgcccgcaaagcattagctacaatctgagaacgaacctcactgttcatatatccgggaagataatttcgcaatggagtaaatgcgataatagcagcagctatcaggaaaataaccgtacaagccgacaagaggacagacagaccgttcagcttagacacatgaatacctactacctcctccaaggtattctcattgataattgtcagtttatacttaaacttgatattatgccaaaaagctttacggcctcttcttgtctttctcattatcctttctcttattctaataatccttccggtatgtcaactttcaggattctttgctttttatccaaatcgacaataaattcttcgtgagcaggaagtaacagttcttcaccgtccttctctatcacaaataaaatattcatcgtagaatcgtcaacagcaacaatttctcccagatttccatgatgtatgtcctccacacggaatcctgtaaagaagttccacgaagtaatttcttcctggtcatccatatatttcttcgggaaataaacctccacattcgtcagcatacgcgcacgttcggcagtatcaattccctcgaacttcatcaaagccacgtcatcggaacggaaacgatactcctctataaaaaacggtaccaatattccgtccagcagcaaaaccaaataatcacaatccacacggtcgaatatatcgtcggtaaaggtaaaagaaacctccccctttattccgtgaggcttgttgattattcctatcttatatacttcttcttttctaatcatacacttactctatacgggtaatacgagcacccaaagcagtcaggcgctgttcgatattctgatacccccggtctatctgttcaatgttatgaatacggctgataccctccgcgctcaatgcagcaatcagcaaagcgattccggcacgtatatcaggcgatgtcatgttacctccacgcaaacggaaattatggtcatgaccgataacaaccgcacgatgcggatcacaaagaataatctgcgcacccatatcaatcaacttatcaacaaagaacaaacgactttcgaacatcttctgatgtatcaggacactaccctttgcctgagtcgcaactacaagcatcacactcagcaagtcgggtgtcaatcccggccacggagcatcggctatcgtcataattgagccatcaataaacgattcaatctcataatgatcctgctgaggaataaaaatatcatcaccccgctgttccaagcgaattcctaaacggcggaaactatccggaataatacccagattatcgtatgatacatttttaatcgtaatctcactggatgtcatggcagccataccgataaagcttcccacttcaatcatatcaggcaatacatggtgcgtacaacctttaaggctcttcaccccttcgatagtcagcagattcgatgcaatacccgatatcttggcacccatacgattcaacatcttacacaactgttgcagataaggttcacacgccgcattgtaaatcgtcgtttttccttcagccagcacagccgccattacgatattcgccgtacctgtgaccgaagcctcatccagcagcatatatgtacccttcaactgattggaagtgattgtgaaaactcccttcgccgtatcataattaaatgaagcccctaatttctgaattcccagaaaatgagtatccaaccggcgacgaccaatcttgtcacctcccggtttggcaatcatagcccttccgaaacgtgctaccaaaggccctacaagcatcaccgaaccacgtaaacgtgagcaacgggtaaggaactcctcactttcaagataagaaaggttcacatcatctgcctgaaaagaatacgtatccacgctctttttagacactttcacgcccatatcacgaagcaactgaatcaggttattcacatccaatatattcgggatattactgattgtcacctcttcgtcagtcaataatgtagcacaaaccacctgcaagacttcattcttcgcaccctgcggagtgatctcgccatgcagtttatacccgccttcgattacaaatgatgccatagtaccggttatttaagattaatattttcttttttgctgattattgttattaacctggcgacggcgtggagtaaatgtacgctgttcgaccagatgaaaatcgtctgccgacagtttaatctttcctcccgacagttcgcacaaatcatccaaaatcttctggtcttcgactccatccttgttccagttctgataatccttcttcatgtggttggctatcagcttcagcaactgatttcgttcttccccttccggataatcgatagcaatcttaatcatatcctgaacaaaacgaccataatggcgatagcggatattattctgagaataagggatacggtcgggctttacctccagactttcctttttcacaatatccaccggataatcgatatcgagcttgaagtcggccataatagccagatgatcccaaagcttatgcttgaagtcggccacatcccgcaagtgcggaaacatgccgcccatgatattgacaatcgtattggcacaacgctggcgttcttcgcggtcttcaatcgtcagtgcgtaatccaccatgttctgcacacttctcccatattcgggaagaggtaattttcgttgttgggtattatattccatatattattgcagattctttctttttatgtttacaaaagtttcttaggagtagaagccacaaactctttcaggtagaaaggttcaaaataagccacatccttgaaatctttttcagccattgcccgttcggcaagcgggaacatccatttggccagcggatgaatattttcgatgaaatgtgcattcggatgcgttatcttctcacgacacttagccgccccgtttccgaagaaatacactggatgctccgccagaaattcggagtatgaattttcatcgatgatatctgcactgatttcacgttttaccttcagtgcacggtcgtatatggcagcatacacttccatacggcgagcatcaatcatcgggcaaagcaaagcatcttccggcaagtcctgaaaaagcaataccggaacagtcatcacctccggagtaggaatagctatcaacggaatattacgtccatagcaaataccctttgccattgacacaccaattctcaaacctgtatacgaacccggtccgcaacttacagccacggcatccaaaggaatggcatgattgtcgataaacgataaagcctcgtccacaaagacacccaatactacagcatgtgagggaccgttaaagtcctctttcgagaaaatagaagctccgtcctgacttgcagaaacagaacatacttccgttgaagtttcaatatgtaaaatgcacgacataaattaattccttattatatagactgcaaatatacacttttatttgcactcacttcccattaagccagtgttttttagaaccgttaataaaagatgaaaagctttggcgaaaaacatcagcatattttcagaaaaacatcagcacgttttcacaaaaacatcagcatgtttaaacgaaaacatcagcacgttttttatactcattgacgaagtattcagtccgtcagagaaaaagttcttctctacttttcggattcacagctttttcctacctttgcgggataaaaaaacagaatattatgatacaatcaatgaccggatacggcaaagcaactgccacattcggagataagaaaatcaacgtagaaataaaatctttgaacagcaaggcaatggacttgtcaacacgcattgctccattgtaccgtgaaaaagaaatggaaatccgcaatcttattaccaaaacgctggagcgcggcaaggtggatttctgtatctggattgaaaaagatgtggccgaaacagccactcccattaatgctgcactggtagaaaactattacaatcagataaaggctatttcagatagttgccatattcccgtaccggaagactggtttgccactttgcttcgcatgccggacgtactcacccgtgtagacatacaggaattatctgatgaggaatgggaagttgccagcaaggctattgaagaagccttgcaacatttggtagatttccgcatacaggaaggtgctgcattggaaaagaaatttaccgaaaaggtagacaacatagagcgtttgctgaagtcaatcgaaccgtatgaaaaagaacgtgtagccaagatacgcgaacgtatcaccgatgcactggaaaaaacgatcagcgtagactatgacaagaatcgcctggaacaggaactgatttattatattgaaaagctagatataaacgaagagaaacaacgtctggccaatcacttgaaatacttccgcgaaacaatggctggaggacacggacaaggcaagaagctgggatttatcgctcaggagatgggacgtgaaatcaatacgacaggcagcaagtcgaatcacgccgagatgcaaaacatcgtggttcagatgaaagacgaactggaacaaatcaaggaacaagttttaaatgtaatgtaatattcacatatagaggagcgaaaaagaagaaaatcggttcatggtatatcttcttttttcgctcctcgtgtttttattctaaattatgggaaaactgattattttttctgcgccgtcaggctcgggcaaatctactatcatcaattacctgcttacccaaaacctgaatctggcattttctatttcggcaaccagccgtccgccacgcggaacagaacagaatggagtagaatattttttccttactcctgaagaatttaaacaacgcatcgccaacaacgaatttctggaatacgaagaagtttacaccgaccgtttttatggaaccctgaaagcacaagtagaaaagcaactggaagccggtcagaatgtcatcttcgacgtagacgtagtaggcggatgcaacattaaaaagttttacggtgaacgtgccctgtcggtatttatccagccaccttctgttgaggaattgcgcaagcgtctgaacggacgtggtaccgatacccccgaagtaatagaaagccgaattgccaaggcagaattcgaactgagctatgccgacaaattcgacgttgtaatagtaaacgatgacttggaaacagccaaggctgaagcactgaaagtcatcagcaattttcttaagaaataacccacacacatcaattatggcaaaagatcccaaaaaactcttgcgcaccatgatgattgtcagcattgtcatcggactggttgctttggctgtagcagtagttgctgttgccatgaaagaatacattattgccgcagcaatgcttatcgttgccggctggcaggtcgtaaactttttaaaatggaagaaatgtctgtaaagacaggagttttcggaggaacattcaatccgatccacatcggccatctggcattggcaaattacctgtgtgaatacggtggactggatgaaatatggtttctggtatctcctcaaaacccatttaaacagaacatagaattactcgacgataacatacgactggaaatggtacaagctgctatttccggctaccctcgtttccaagcttccaactttgagtttaatttgcctcgcccttcgtatacggtcgatacgttgaaccgattagcagaagcttatccagaaagagagttcaccctcattatcggggcagacaactggactgctttcgaccgctggaagtcacccgaagaaattatacgcaaacacgctgttattgtataccctcgtccgggttacgatatacaaacagacgtacttccgcctcgtgtaaaagtagtaaataccccccttctggaaatcagttcaacatttatccggcaggctatcagcgaaggcaaggacatacgctactttctgcatccggaagtctaccgtatcattgcagaaaaaaaactataccaaaaataaacaacatgaaaacctacaaattctatcttctctctttagcaacatgtctgctattgggaggaacatccagtgctgaagccaaaatcttcggcaagaaaaagaaaaaggccaaaatagaacaaccggtaactccggtcaacagaatgacaaacggactgaaaccttatgccagcgttattacacctaaagccaaaagttcacatggctttataaccattcacaaggtaaatgatgcgtattttatggagattccagattctattctgaaccgcgacattctgattgtaaaccgtatcagcaaagccccagcctcacttcagaaatcacgtgtcggttatccgggagatatattgggcagcaaggtcatccgctttgaaaacaaagacaacaaacgcattttagtacgagagtactcttatcgtgaacgtgccgaaaataaagacggcatgtatcagtctgtactgaactccaacattcaacctatcatagctagtttcaatcttgagactatgaaaaaagattctcttagtcgtagctatgtaatcaacatcagtaccttcctactcaaggaaaatccattattttctttcgaggccgaaatcaaagaacgtattggactattgaatatggtgggagaaggaacatacatcaatacgctaaaagcctttcctcaaaacattgaaattagtactacggttacataccaaggtaaaaaaggagcgaacaatgctggctatatgccaacaagtaattctcgcattccgctgacttatgaactgaatagttccatggtgctgcttcctgcaatcccaatgaaatcccgattattcgatccaagggtaggttactttactgtaggatataccgatttcgacagcaatccacaaggtattgaatataaaaatctcatcactcgttggcgtctggaacctaaagatgaagcagcctacttacgcggagaacttgttgaacctaagaagccgattgtaatttatattgatccggcaactcctaaaaaatgggttccatatctgatacaaggagtgaatgactggcagatcgctttcgaaaaagctggattcaaaaatgcaatctatgccttagaagctccaactgacgatccttcttggagcttggaagatgcccgtcattcggctatcgtctataaaccatccgatatacccaatgccagtggaccacacatccacgatccgcgtacgggagaaattttggaaacacacatcaactggtatcataatgtcatgaatctgctgcgcaactggtacatgatccaagctggaacgattgatgaagcagcccgcaaaatgcagttcgacgatgaattgatgggacagctcatccgtttcgtttcttcccacgaagtaggacatactttaggacttcgccacaactttggttcttcacataccgtaccagtcgaaaagttgcgcgacaaagcatgggtagaagcaaacggtcatacgccttccattatggattatgcacgcttcaactatgtagcacaaccggaggacagcatcacacgtgccggcatttttccacgtatcggcatatacgacaaatggtctatagaatggggctaccgatggttaccacagttccaaaaaccagaagacgaaatcgctttctctaaccagtccatcattgaaaaactgaatgcagatgtacgctatacctttggaaccgaatcggatgtcaacgacccgcgcaatcaaagtgaagatttgggcgacgatgctatgcttgccagttcatacggaatcaagaacctgaaacgtattgttccacagatattgaagtggtcgtacgaacccaacaaatcatatgctggtgccggtgagatatacagtgcagttgtttcccagttcaaccgatatttgggccatgttactaaaaatatagctggaatttacagtacacctataactgttgaacaatcgaatgcaacagcacgtgaatttgtaccagccaacatccaaaagcgagctgttgaattcctcaatgaacaattgttcaccactcctcaatggcttattgaccgtcaactgatagaaaaggctaagattcttcctgtaaatgtaatctgctcactacaatcggatatcctcacacgactcatcagcaaggcaacactcgataagatgagcgaaaatgaaacactgaacggcaagaaagcgtatacctcgacacaaatgttcaacgatttgaaaaaagttatctggagtaatctgagccaatcagatatctacaaacgcaacatgcaaaagacatacatagaatgcctcatcagcctgctcgacaagccagaagctgccagcaaaaatacatcaggaaagcgaccggcatactccgaggcccctgccatcgcccacggacagttagtagaattaaaacgtttgtcggccaatgcagctggaatgacaagtggtacagcccgaggtcactatcaaaatctggttacgctgatagacaatgcactaaacgacaaataaaaaatacgaagggataaaactttaacacctcgccgaaagattactaatcatagcgataaaaagccgaagggtcgtatcaaactcagtttttttgagtaatgatacgaccctttcttttgcatttaccaatgactaactcgcagcttaaaagttcctctttactaaaaagaaggcttgccccactaagtctttatttcacctccaacacaacaatcgatttagcaggaaggttaatcttcaatccgttcttagtagtctttgcccctttaaaatctttaggactaactacatctggatgctcaaacgagttatagtcatccacattcttcgcagtcagtatacgccctgaaaccgattgaacctgtacgtcgtttaaagacaaagttatatcctgcgattcctccaaatctacattcgacaaggaaatatgaattacaccattcttgtcgcgtgaagccgtcgcactgaccataggtacaatccggtcgtcacgtacaatcttacgctcacactgcaaatccatcggaagataagtagcatcctgatgcaccttatacatttcaaatacatggtaagtcggtgtcagaaccattttatcgtctttggtcaaaatcatcgactgaagtacattcgcaatctgagcaatattcgtcatcttgatacgatcggtatatttatgaaatatgtccaaagtgagtgcagctacaaaagcatcgcgcaacgtattttgctgaaacaaatgtccaggtaccgtgcccggttcttcatcccaccaagttccccattcgtcaacaatcagtcccacacgtttctgcggatcatatttatccataatagcaacatgacgtttgattacatcctctatttcacgacatttccccaatgtccagtaataatcatcagtcgagaaattagttgccgaacctttactgcccgaccatcccgaaactgtataatagtgcaatgaaagtccgtccatcagcggcattgctttttgcatcaatacctctgtccaacgataattataatcacctgctccactagcaatcttatacaaacgatttccaccatagttgcggcaataagtctgataccgccgataaacgtctgcataatattccggatacatgttgcccccacatccccagctttcattaccaacacctatatattttactttccagggcttttcgcgtccgttttccttacgcaactttgccatcggactaccttgctcggctgtcatatattctacccatttggccagttcttctaccgtaccactacccacattgccactgatataaggctcacagcccaacatttcacaaagattcaggaactcatgcgtaccgaaactgttatcttctaccgttcctccccagttattgttcaccatcttcggccggttttcgcatggtccgataccgtccatccaatggtattcgtcagcaaagcaaccgcccggccagcgaagtacaggaactttaagatttttcaaagcttccaatacatccgtacgatatcccttgacattaggaatagaagaatcctctcctacccataaaccgccataaatacatgttcccaaatgttcggcaaactgtccataaatttctttgttgataacttgcgttccttgttgcggatgaaccgtgaccattgccttttgctgtgcgaatacaggccacaccacacacaatgccagccctaaaattgtgtttttcatatttttctttattatttaaattgtatctcactgcttttcatataaaggtgttttcccaacctttatccagcaacaaaaataaatgaaaacatttcattaaaggaaacaatatgttaccaattaatagcttatttgttacctcccagtttttcagagctcaaaacaatcttttaagcatacccccaatatcattctctgcacgctgcttacaaaaaaaggatgtgcctaagctttcgcccgacacatcctttatacttacctaaagattcatcaatctatattacccgatcaattattcttgaatccataaccattggtaatcttacccaatgaagtttccaaaatagaactatggaacggtacgaagtaaataggtgcttcaccatctacaaaaccacggaatacataatctgagtaatcagtttcattatcgacgatatctttaccccagttaaccatcttataaccatcagcttccaatgcttttgcttctgcactacccggttcgatatgcttgaacaagccttgaatagccaagttcgtacccggattagccggatagattgaattacccgtatatccttcccaatcatcaaaaacaccacgccagcccggatacattaccggatctgtttcatcggtgcattgagtggtcaaacggtaaccatactgcgctttagcatccacgctctttgtccagatatacaatgaaatggtatttccattttcgaaagtgtaataacctttagtcttcaatccgttcaccatttcagccagatcagctttcaacttcttaatggcttccggcaacttaccagtacgaatcaaatcgtaacgacgaagaccttcaccaccaaattccagtttacgttcctgctgaatagcttctttgacaccaccccacttcgagatgaaaccgtcaagattagccagttcaggagttgcaaacgcacggttatgtacttccgacaaatactgtttagcagtcatctcgtcacccagttcggcctttacctcggccaacatcaggataacatccgacatacgtacaaacggattattaataccagactgacgctgtttttcccagcgtggtgaaggctgtcgattttcatcccatttattattggcaatgcctccgccattagcctgtgaacccggagtaaacggtaacagcttttctacaccattctttccatcagagcctgttactgtacaagttacatcacgacgcatgtcgttcggatcgaaatcaccataataataagtagggtggaaacggctctgaccatagttcttacatggatagttgtttgagctacctgctgaacttggacgtccgaaagcataaggacgttcactctgcacacctcttgtttcaggaatttcataaatactttcagaagaaagaaccagatcgttgttctgctggaatatgtactgataaggattaccaaatgcctgaccattggaaccaaccgaacgaggatcgactgtacacaatgcagctgtacccggatggtctacgcaattctgcaaatacgtttcggctatttcgtagaacttcttgtaatctgtacgtctgccgtaaaatgcattgtttgcatccaccgtattcaatttttcaaaactcaacacattcccatccagatctttataaaaatcggaacccaggtcggtacgacgagtagaataaccaccagcatacaaacacatacgtccgatcaaagcgtctacatagttacgagtcatcatactggcatcagccgtagccgtttcacccaaataatacatgtaaggttccacctgaatcagtttgttgatatgatattcataaatctggtcacgtggagtcaaaccttctgctaccacgccaggaaccaggttatgaggaacatccccccaaaaacgaagcaattcattataagcagtcgcacgcaaggcaacagcctgtccgtagaggtcggtcatttcggtaaccgatcccgttcccgcctctatagcttgataggtctccgttccttcaatagcgttacaaagtgtattacatgtagcaatgatgctatacaatgccggccatgcattgataccattattaccagccgagttgatatcgaaactggaagttccgccataatacagattctccgggatatgacgtgcctgtgcatcgtaaccttcaggatgacgttccgaatcggagccacagactaccaaatcgtaaaacaaaccgttggcatgaacataggcttttgcacgccacttttcataagcttccattaaggcaccacgagccgtcgaaacatctccaaaaacaaactccggagttgcttcagaaggtgaagacgtatccagaaaatcctcacatgaagttatattgagcattaaaagtccaacacctaaatatgtatataataactttttcattgtcttttcattgattagttaacagattatttattagaatgaaatgtttacaccaaatgtaaatgttcttgcacgaggataagtaccatagtccatacccagcaacggatagtttcctgtgttagcagcagttgtactcttattcggatcggcattaacttccggatcgataccagaataacctgtgatagtaaacaagtttccagcagtagcataaatacgcgcacgctgcataccaattttctgagtccatgctttcgggaatgtatatccaatggtcaatgtattcaaacgcaagaatgaagcattttcaacaaaagtagacaatacagtaccgttttccatgtaaggtacaccatattttgcaccagcattcaatgcgtccaaagcatctggatctacaacaggaaccagttcaccgttctgaatgtcatatatctgatagcaatctttgacaaatgctagtttgttggcaccagcaccggtatccttatttccatacatgtttatcaaagagttgacattgtaaacatgaccacctactgcccatgcaaatcctgcactgaaatcgatgttcttccatgtcatgttcaaattcacaccaccagtatgaggatgagcaatttctcccaaatcggtaacatcatccgtatcggctacaccatttccatccagatctcgcaacttgatagctcccggaaatgccttttgcccttccggcaaattataatgactaggatagttacctacctgatttcccaagtcggctacacctggtttcaacgtatacatctgggttgccggatcgtaattgaaatcggctgttgtatagaaaccgtcacagatataaccacgaatcaagccaacaggctttccttcacggaactcatagtcgtaagtcggagttgtagcactggaagcccactgagaaccgtattgtgcaatgatattatcggccagttcatcaatgttattatggttatagttgtaagttgcagaaataccgaatgtaaaatctttagtacgaacaatatcgtagttcaaagcgatttcaatacccttattggaagtctgtccgatgttctgatactgatatgaataaccagtagtttcgtcgataggaatacacatcagcaagtccttggtcgtattccaatatgcatcaatggtacccgaaaggcgattgccaaagaagccgaaatccaaaccaatgttacgtgaaatggttgtttcccattttaagtccggattagacaacataccatttggcttgtaaccggaatagttctgaccgttgaatgtaacagtagtagactcccacgtttctctccaaagactggagtcaatgttatcagcacccgccataccataagataaacggagtttcaggttatccaaccagttgcgagtaccttccataaatgcctcatcagaaatacgccatgcaagtgcacctgccgggaagtatccccaacggtgattcggagcgaacttagaagaaccatcggcacggaatgtcactgtaagcaaataacgatccagcaacgaatagttagctcgagcaaagaatgaaacagtcttgtcgggagtaccgatcgtattgctgaatttatcttttgccaaagttttatcagtctggtcaatcataccaaaggtctggtcaaaatcaaatccgtcaggatatccgtgaccttcaatttctgtagaattcgatttcgacacgattgtttcctgaccaaacaggaacgacaagtcatgatcgtcacctaatccctgaacctgataattcaatgtattcacgttacgcaggttatagccttcgctacgagttaacttagccaccttatggccttgtgtcaagccgttttcataatacttggtttcaccccagttacgtccgccacctacttcggcacgcaatgtcaagccgtcgattatatcccatgaaagagcagcaatacctctcagtcgttgtttccttgcaatattctgcatatcgttcgtccagtcgactggagtaccatagcccatatcaatattatcggcacccaaaccaaatccaccgaaagcgttagcatcacccagcggattatcaatcggacgccagcgataagcacccgacagcaacgaacctttaccatttgtagacgattccttacctgtagtctgatcttccgaatagcgaatatccacatccagtttcaaattcttcaacagctcctgattcaatttcaatgaagtattgaaacggttataacccgaattaattttaataccttcatcattcagatagtttacattcaatacaaacttagtcttctcgctacctcctgaaattgaaaggttatgcgtatgagcaatcgcgttgcgcaacaaatcgtctgtccagtcgtgtacgcccacattagcataatcagcataatggttaccataagcactgcctaatccgaaatactgagcaactccatcagcacttactgcaccaccggttctctccaaagcatcggcataagcccactggtatttcacataatcctgtgccccgagtggctccaatgttttcgcagcactctttgtctggatatatccgttataagttacagacagcttgtcagtcttagcgcctttggtagtaaccagaattacaccgttcgcaccacgagcaccataaatagcagtagacgacgcatccttcaatacatcgatagactcaatctggtcggccggaacatcagaaatagaacttaccggaaaaccatcgacaataaacagcgggtcattgctctgcgtgatagagcctccaccacgcacacggatagaaacttccgcgcccggacgaccatcctgtgaaacaaccgatacaccagccagcttaccttgcaaagcctgagatacgtcggaaaccggattagcggtcaaggtttcattatttacagatgatacagaaccggtcaaatcacgtttctttaccgtaccataaccgataacaacgacttcatccaaggcctcggtatcttctttcaagataatattaaaagaagatttgttcccaaccgcaatagactgggatacataacctacataagtaacagtaagtacatcggaatctttcacatcctgaatgacaaactttccgtcaaaatctgtaatggttccgttagtagtaccttttaccaacacattcacaccaatcataggttcaccggcactatccttgatgataccagaaatttgtttaccttgtgcaaatgccagtacacagagcatactcagcaaaaatgtagaatacactcttttcaaaagtagtagtctgttcatacgtgtttttagttttagataataaataaggttaatatttctcatcgaatcacaacgtctcaaaattagaaacataccatcgaatgaattgataaaaagtgtttttttagtagtaaaaattggtttttaaccaaaatcagtccttatgaagtattaccagaaccacctcactgggggtaaacaggcggatatctttgcgcgacgtacctatcccgttactgataatgacgggaatcccctggctattatgtttcagaccagtaaggaaacgattaccatattttgaaaaatgtgccggagtatatttacggaagaaactgacttgtcctccatgtgtatgccctgccagtgccaagtcggtgttactgatatccacatcctctacataatcaggggtatgagtcagcattacgacataatcttctgcccggagagataaggtcggcgaaaccccgttttttgtcaaatcaaacggattgcgaattccacaaatcaaaatatactgatttcctttccacaacgtatcaacctgatgctcgagcagacgaacacctgtccgctccatctctcgctttacgacttcataattggcattattctcatggttccccattaccccataggcaccataagaggtatgaaactgctgaagtacatcaaataattccgacagatttcccccgttccgtccccgataatcgcctcctaatagcaggatatcggcacgagtagcctgtaaggctttcaacaaggcaggaagtcttttccggtcgaaacggctttcataatgaaaatcggaagcaaaggcaatccggaatccgtcaaaagaatcaggaagctgcttgctgtatatatcgtattttttgacacgccctatcccatgatattttgacaaagaagccgtagcgcacgatgaaagcacaatcgtgagtgcaagaacgataaaataaatcatttttttcatgactataccacttgaattttcaaacgaaaataacacttttcctctggtccggcaaagtctcggcagaatttcctaactttgcaccagcaaataaatcggatttatggtaaaacaaaactctacaaaagcctggttgcttgccagccgtcccaaaacgctgacagccgcctccattccagtgatgctgggatgtgcactggcctcaatgtacggacattttcaactgattcccgctatattgtgtttcttattcgcctttctgatgcagataggcgcaaactttatcaatgatttgtatgattacctgaaaggtaccgaccgggaagacagactgggaccggaacgtgcctgtgcacaaggctggatttcgccgtcgggcatgaaaaagggtatcgtcatcactactttcttagcagctttagacggcctctgcctgctttggtacggtggttgggaaatgattccggtaggcattgcctgtattatttttgcctttctatatacgacgggaccttatccgctagcttaccacggatggggagacgtactagtgctggttttcttcggattcgtacccgtaggatgtactttttatatcatggcacatagctggaacacgtctgttaccatggcttcgcttgcctgtggcttggtcatcgataccttgctgatggtcaataatttccgcgacagagagcaggatgccatcagcggcaagaaaacaatcgtagtgcgattgggtgcccgtgcaggactgattctgtatttcctgctgggactggctgcctgctggagttgtttttatttcgtaagcgaaggcaggctgtgggcagctatcctgccgcagatttatttgttgctccatatctttaccaccgtaaagatggcacgcatcaaccgcggcaaggagcttaacgccattttgggagaaacttcgcgaaacatgttgctattcggcatactgcttacagccggactgttgattaccgtctgatgatcatttatctttttactttatgaacagtagaatcaaggaactcgattttttgaaatgcatattcatcattctgatgattattttccacctggtatacatcggcgactcgtacccgtatgccaagcaagtggtttatacatttcacatgtcggcatttctcattatttcgggttacttgaacaatataaacaaggaaacaaaggctgtcggtaggagtctgctctggatattcattccgtatgtcatcatggaagcaggctacgtggtcatgtcggcagttctccccgtgcgggagaaggtagacgaactctctgctggggttctgctgtacaaagcgctcattgctcccatgggcccctactggtatctgcatacactgatactcagcaatgctagttattttctaatctataaggtaacgaataagtggaaaggcatcatccgttttatcatcttgggaatatttctgtatattctttccgaactacggttattgacgtttgccaatgccatttacttcctggcaggagtggctatccggcaaagtggccttcccattatccgtgtgtttcagcccagctttctgtcggtagtccccctcgtcatcttatgctgtttcccggagaacctgaaccgcggcacactggctggtgtaaccataacctatttggtaatcagcctgttgcttgccacatacacttatttaccggaaaaagttaaaagactctctctttatataggcagcaacacgctggtgattcttcttttttcacccgtgtttaccattttatcgaaagcctatctgccactttttgccttcgatgcaacgggcatctgttttacgattgtctcggtgattttcgttatctgcggatgtttcgggatgacgtatgtactcgaccgcctgcatatctcgccttattttttaggaaagaagcggatgcttcctccctatcctccagccgactaatcacgttctatcagtacagtggcgtatgccgaaattccttcttcccgaccggtaaagcccagtttttcggttgtagtagcctttatcgacacgtcttccggatctatattcatgacatgagccagcacttcctgcatttcgggtatgcgagccttcagtttcggacgctcggcacaaaccgtcgcatcgatattgcctacccgataacctttcgtagcaatcagatcgactgtacgtgccagcagaatcttactgtcgatacctttaaactcaccggcattgtcggggaaatgatagccgatatcacgcatgttggctgctcccagcaacgcatcacaaatggcatgaatcaacacatcggcatcggaatgtcccaataatcccaattcgtgctccagcttgatgcctcccagccagagttcacgtccaacgaccagccgatggacgtcgaaaccaaatcctacacgtattttcatcttacgtaaaaatcaagaactttttcgttttccaaatatccttccaggtgattgtttatctgtaccggacccactcctaccggcgtaccggtaaacagcatgtcaccaatcttcagtgtacagaactggctgacgtatgcgataatctgatccacacggaaaagcatgtcctgtgtatttccctgctgcacagtctttccgtcaatatccagatggaaattgatatgctgaatatccgcaaacttctctacaggaacccagtcgcctatggcagccgagttatcgaatcccttgcacaattcccaaggtttcccttcggcacggaacttgcgctgcaaatcgcgtgcagtaaagtcgatacctaccgtaacggcatcgtaatagcgatgtgcgaaacgctcggaaatattctttccaaggcggttgatacgtaccaccagttcggtttcataatccacctgctggcagaaatcaggaataaagaatggcttgctgtccttcagcaaggcagaatccggtttcataaagataaccggctcttgtggcaatggctcgtctgcatgcaattccttgcaatgcaacggatagttcatgccgatagctataattttcatggagaatttatttctttatggtttcattcaaacgattgaacatcaccgccagatgcgcatatagtgatgtattctgtactacaatgttttcgggaacccgaatacggaaaggagtaaaattccagatagccttgatgcctcctgcaatcatcttatcggaaatctcctgggcaatggtaatggggacagtcagtacgccgatgtttaccccgtcttgtttcatgcgctgctcaaagtcatcggaatgataaataggaattccgtttatctttgtacctaccagctccggattgatatcgaaagcccctacaatctgaagtccgaaatgcgaaagacctgagtcgcgcagtaacgcccccccaggctaccaaccccgaaaagatacgccctgtgcatattggtaaatcccagaaaatcctcaagtacctgaatcagcaagtcaatatcatatcctacacgtgtacgtccggcaatatctacatacgaaaggtctttggcaatctgtgaagcgtcgatattgatctgcttggatatctgtgtggaagaaacatacttctcccctttctctttcatcagctttgcattcgaaagataccacggcagtctacgcagggtaggctccggtattttatccgtatttttacgagtacgtattgccatttttcacgcttctgtaaaattatgccttttgcaaaattaagctatttattcggaaacgcacacagaatatagaaaaatgtacctatctttgagtcggattaaaattaattcacatgaaaaataatgattggaaagaccgactgaacattgtatattccaccaatccggactttcagtacgacaacggagaagaggaagaagtggaaacgctggataagaagcagcagaaacttcgcgtttcaatagagaaaaaaggacgcgggggaaagaccgtaactgttataaccggctttacgggcagcgaagaagacttgaaagaactgggcaaactgctaaagaccaaatgtggtgtgggcggatcggtaaaggacggggaaatcctcattcagggagagtttcgtcagcgcatcatcgatttactgaaagcggaaggttatacgcagaccaaataacattccgcatatcctatttcggtatttcacatcactgccagcaagactcttgagttttttgtacaaattctctgatttcttgtacaaattttcaaaaaacgtcctgacgtttttttcgcagaataccgttctttaaaatgtttttctttagacaaactgacaaaagataaaacccttttatgactatcacgtgtgaagggcgtgaagggcataaaagggtaatttttttatttaaaacagaggatttatagagaatcatatcaaaaacttattctcaaagaaacctccattatattgcgcacgtcattgatgtattcaaccagcaaacaattgggatataataaaaaaagccagccacttccatcaggaagtcagctggcttatctattttataaattattttctacaaaacagtagaattattcagcacgcaaagtgaagcgtttgaagtctgtaatagccaattcaggatcagcagccttcaaaacatcagcaacgctcttcttcggttccataatgctttcctggttcaacagacaaacttctttcaagaatttgcccagacgacctttagcaatattttcaatcatagcctgaggcaggtgagcagccttttcagcagctacagtttccttgatttctttagccttagctacatcttcagcagtaatccatcccttagccatgttgctttccatgtgctcctcgctatcaacatgagcaggattgataccagctttcttcaaagcagcttcaacagctttctgtacctgttctgctttagtcttttcaatagcgacattgatttcttcttgttttacagcttcaggaacacctgcttcgtcgattgcgatcgggttcatagctgcaatctgcatacagatttcgtgagcaatcttttcgtcacaaactttattgaaagcaacaattgtacaaagctgatttttgttcatgtggttgtaaacagctgtgcaagcaccagaaacgaagaaatagccatccaattcagtcttttcaccagtgataccgctacgttcaacgatagcatcagcaattgtaccgctacccatcggaagagcttttacttcatccaaagtctgacatttgttagcgattgcagcatccaggatagcctgagtcaaagcaacgaaatctgcattcttagcaacgaagtcagtttcacacttcaaagcaatcattgcagcatagtcaccagttgattttgccagtacacaaccttctgaagtttcacggtcagaacgttttgcagcaacagcctgtccttttttacggataatttccactgccttgtcgaaatcgccttctgattctgtcaaagcgtttttacagtccatcataccagctccagtcattttacggagtttggtgatatcagccatacttacagccatagtaatttcttttttattgagttaataaattaaatctgttataaagcaaatgagagttgagaacagagagttgagaattgccttttatagtaactctcaactttcaactctcaactctcaccttaaagtatattaagcttcttcgtctttacccatgaaagcggcagcctttgcagcattgatagcttcttcttctgccttatccatacgagccttagtagctttcttcttagcagctttcggagcattttctccagcagcttccatgtctactttttcagcttttctttcttccaaaccttctgccattgcagcgcagcaagcatccaagataacttctacagacttagtagcgtcatcattagcaggaattacgaaatctacgtttgtaggatctgagtttgtatcaacgatagcaaatacagggatacccaaacgattagcttcgcgaactgcgatgttttctttcaatacgtctacaacgaacaaagcagacggcagacgagtcaaatcagcgatagagcccaagttcttttccaacttagcacgctgacgagaaatctgaagaatttctctctttgagaggtttgaataagtaccatcgttagtcaacttatcgatagtagccattttcttgacagccttacggatagtcgggaagttagtcaacataccacccggccaacgctcgattacataaggcatgtttacagaagcagctttctcagctactacctgttttgcttgttttttagtagcaacgaacaggactttctttcctgattttgcaatctgcttcaaagcttcagcagcttcatcaactttagcaacggttttgttcaggtcgatgatatggattccgttgcgttccatgaaaatataaggagccattgcagggttccactttcttttaaggtgtccgaagtggcaaccagcctccaataaagtatcaaaatttactcttgacattgtttttaatcttttaatcgtttactttcttttttgtttaattgaaccaactgccgggtagtttctccgcaaacacttgtagggaaaatcccgacggtttagatactaaacgcttttttagttgagagttgaaaagtgaaagttgaaaaaaataagcaacttgtccgttccaacattccaccaactcttaacgtttactgaactggaatctacgacgtgctttcggacgacccggttttttacgttcaacagaacgaggatcacgagtcatgaagccttctgcacgaagagtcttcttgtcttcggggttaattttaaccagtgcgcgagcgatagccagacgcaaagcctgtgactgacctgtaaatccaccaccacacaagttaactttaatatcatatttttcagctacttccagcttattcaaaggctgttttactacatactgcagaatagttgatggaaagtactgtgcaaggtctctcttgttaatagtaatctttcctgtaccttcgcttacgaaaacgcgagcaactgcgcttttacgtctgcctaatgcatttactacttccattctttattatttaagtgtgttaatatcaattactttcggagtctgagcttcatgtttgtgttcagcgccttcatatacataaaggttgcccagcaacttagctcccagacgatttttcggaagcataccttttactactctcttcatcaatttttcagcgccattcggcttagccatcaagcgagccggagtgatttcacgctgaccacccggataaccggtgtagctcaagtagattttatcattccacttgtttcctgtaaatttcactttgtctgcattgatgataataacgttatcaccgcagtctacatgaggggtgaagtttggtttatacttacctctcaacaactttgcaactttagcaccgaggcgacctaccacctgatcggtagcatcaactacgacccattctttcgtcgcagtttccttgtttgcagaaatggtcttgtaacttaaagtatccactcttaaatcttttttaaaatgttaactactaaaaaacgattcctagggctttattcttcccggacaaagaagattaaagcattcagaattaaacttttatcactatttgataataatcggcttgcaaaattactgcttttatccgaactgacaaagattttaagtatttttttctgctgtcaaggctctgactcacggctaattagcgaacgatattttccggataagcagaaggcatcactactcgtttccaaatttcgtgacaccatgaatcaatcttattgccatcacggtctacagtcagataatatttcacgaacattaagttaccatcttcctttaattcaaagtgcatatcattcttatctccattcaactgaggcaaatgcaggttcttttccacatattcagtatatacactttcggaattctgcttataagttccatatccgataatgatagccccactctgcatcatcaccaggttagtgaaacgtccatcgtcagaaagaattttaagagaattacttgtttttaactcgcctacaacatccggagagctggaacgatagaagcacatttgccacactccattcaatatcgttggagttttttcctgaatactctgagccaacatattcgttgcacctaaaaagaggcacaccaaccaaaagaacaaagaacgtgttttcataacgaatgattttaaaaggttaaacaaaaaacgagttgatatacaaatatataaaatatatcttattaaaagttacaaatcttgtttttattttatctttttcaaaagaatttcaagataaaaagattctccatctactcctttccttatttataatatataaaaaaggcgaacctccgattagaagctcgcctcgatataaatatgtattattgatttagaattcagcgtttcgtggagtacgcgggaaaggaataacatcacgaatattagacatacccgtaacgaacagcaacaaacgttcgaatcccaatccaaagccagagtgaggacatgaaccgtatttacgtgtatcgagataccaccacatatctttcatcggaatattcagttccttgatacgagtaagcaacttatcatagtcggcttcacgttcagaaccaccaatgatttcaccgattttcgggaagaggacatccatagcacgaacagtcttaccatcttcattctgtttcatatagaatgccttaatttctttcggataatcggtcaagataacaggacgtttaaagtgatcttccaccagataacgttcgtgttcagaagccaagtctacaccccaataaacagggaattcaaacttatgacctttggcaacggcatcttccaaaatcttgataccttccgtatagggtaaacgtacaaattcttctttcagaacaccctgcagacgttcgatcaattccttatcgaacatatcgttcaggaatttcacatcatcgtagcagttatcaagagcccattgaacacaatatttaatgaactcttctgccaagtccatattatcgttgatatcattgaaggctacttccggttcaatcatccagaactctgccaggtgacgtggagtatttgaattttcagcgcggaatgtcggtccaaaagtatagatagctcccaaagccgtagctgccaattcaccttccaactgacctgatacagtcaaactggtctgttttccaaagaaatcgttatcataaataatcgatccattctcatccttcttcagatcatacagattcatggtagtaacctgaaacatctgaccggctccttcacagtcggaagctgtgataagcggtgtatgaaaatagaagaatccacgttcatggaagaacttgtgaatggcgatagccatattatgacgaatacggaacacagctccaaaagtattggtacgcggacgcaagtgagcaatctcacgtaaaaattccatagagtgtccttttttctgaagaggatatgtattgtcacaaacacccagtacttcgatttcacgagcctgaatttctgctgcctgtcctgatcctactgattcaaccagttcgccattcacactgatacatgctccggtagtaatctgcttcaacatctcttcatcgaagtttgccagatcgacaactacctgcacattatttatagtagaaccatcgttcaaggcaatgaagtttacctgtttgctaccacggcgagtacgtacccaccctttcacattgaccattgtcccgaaatcacggcacttcaaaagatcaacaatttttgttctacgaattgtttccatgttatttatttcattaactaattactcaaaagatcccatacggagcatgtttacttcctgctctgtcaggtaacgccagtcgccacggcgcaagcccttcttggtaagtcctgcgaagtatacacgatccagcttaattacacgatagcccaatgcttcgaaaatacgacgaacaatacggttcttacctgaatgaatttcaatgcctacctgcgacttatccgtatccgatgcatagctgactgcatctgcatgaatttcaccatcatccaaagtaataccggcaactatctgatccaaatcagccttagttacattcttatcgcaataaacatgatagatttttttcttcagatatttcggatgtgtcagcttggaagccaggtcaccgtcatttgtcaacagcaacacacctgtagtattacggtccagacgtcctaccggataaatacgttccttgcaagcaccctttacaaaatccatcacggtcttacgttcctgaggatcatcggatgttgtaacgcaatcttttggcttattcagcaacacatacaccttacgctcgatattgactggctggtcgtggaacttaatctcatcagaacgcttaactttcgtacctaactcagtaaccactaccccatttaccgaaacaactccggcagtaataaactcatcagcttcacgtcgtgaacaaataccagcatttgccaagaacttattcaagcggatcggttcatccgggtcagtcagtatatccttatattctatctgcttcttcatgctatacttagcattcggattgtagtcggctgtacgtggacgataaccgcctccctgctgacgattgtaaccaccctgctggcctccgttgttgaaacgcggacgttgcgaacggaaaccgccttctccctgctgggcattattgaaacgcgggcgatacgaacgctgttctccaccttctccattattgttgttattataacgagagttataggaacgacgcggacgagcattattattaaagttcggattatacgaagaacgttcgcctccattattatcatatgacgggcgattgccatacgaacgctgtggacgatagccaccttcaccctgctgatcaccgttattaaagcgcggacggtacggacgttgttctccaccttctccattgttattattataacgagagctgtaagagcgctgaggacgttcacctccttcattgtttgaggtaaagcgcggacgacgtccatagctgttacctccctcattacggttgtatctgttataaccttctctgttgtaagacttgtaaccatcgcggccagactgagtgttttcactatcctgtctgttttctctttctgccataattgttgttttctatttatagattaataattacacccttctcgggctaaactctttttatatattttacattccggtataattgtgcggagtaatcgcgcgcaattcttttttaatatcttcactgacattcagtgtttcaataaactctttaatagatgcctcggtgatagcctgattggtacgagttaatgctttcaaggcttcgtaaggatgcggatatgcctcacggcgaagaattgtctgaatagcttcagctaccacactccagcaattatccaaatcctcataaattttatgttcattcaacaacagcttgccaagtcctttcaatgaactctgaatagcaatcactgtatgtccgaacggaacgccaatattacgcagaaccgtagaatcggtcaagtcacgctgcaaacgtgatatcgggagtttagaagaaagatgtgccagaacagcgtttgccatacccagattaccttctgcattttcgaagtcaatcggattcaccttatgtggcatagcgctcgagccaacttcgccagctttgattttctgcttgaagtattccatagagatatactgccagaaatcacggttcatatcaatcatgatcgtattgatacgcttcatggcatcgaatatggcaccaagattatcatagttggaaatctgagtagtatattcttcgcgttccagtcccagtttctctgcaacgaacttattaccgaaagctttccagtcgaattccggatatgctacatgatgagcattataattacctgtagcgcctccgaatttagcagtaataggacatgctttcaaaacagccaactgacggttcagacggtatacaaacaccatgatttccttacccagacgagtaggagaagcaggctgtccgtgtgtctttgccagcatcggaatatctttccattcttctgcatacgtagtcagctggtcaatcagtttctgaatctgcggataataaacctcattcaatgcatccttgatagacaaaggcacagaagtattattgatatcctgagaagtcaggccaaaatgaatgaattccttgtaatgttccagtcctcctaacttgtcgaactgttccttgataaaatactcaacagcctttacatcatggtttgtaacactttcaatttccttgatgcgctgagcatctgcttccgaaaagttacgatagatatcacgcaatgattcgaaacgtgccgaatcgaaacttttcagctgcggcaacggcaattcacacaaagttataaaatattcaatttcaacccgcacacgatatttcatcagtgcaaactctgaaaaataagcagccagagcaccggctttgcttctgtatcgaccgtcaataggtgatatagctgtgagtaaatcaagctccatcatgttttacaaatactttttgagtctatataatgatcattattgagagtgcaaaggtaatgttttttcccgagttgaagggagtaacatagaaaactttagtatttattttacaattatttccgattgaaagccaatagcggcacaaaagcaaccgaactatgttaatcttgctaataattggaacaatgaaacgcaaaataatgtaattttgcacccgcataaaaaaagaaacaatcattatggaattacctaaagatccgatgatgctgttcagcttcatcaacatgaaattgcgtgatttctacccttctttggatgcactttgccaagacatgcaggtcagcaaagaagaaatcgtaaacaaactgaaagccgtaggatttgaatacaatcctgaacaaaacaaattctggtgattattcatgtgaatatcaccagaatttgtttttatagcttaatcatataaccttcgcttacaacgatatacttttctataccctaagcggttcaagagtaatttacctcctattttccactaaaaggaaaacatttctcaacgctcgacatacagattccgcaaagataacaagcaagcagtttcaatgatgctcattttcgataaacaaaggaaacaaacctcaatctaaacactatcagcgatgtagccaaagttctggattcagtttttctgtctctttacgaagctgaaaatggaggactgtattaccatctttatctgtatttaccggaccaataatatcacgggctttcaggacactaccttttttcaccaataccgacgacaagttacaatatacagatatgtaactaccgtgacggataagaacattcgacagtccattatactggaagattgccgaaacttccccatcaaatatggcacgggcttgagcgccgtccttgccttttatgtcgattcctttattgtccagacggacattccgcaatccttttacctgatactgtccaaaatgcccaacaatcacatagggacctgttataggaacaggaagccgtcctttgttttgcgtaaagatgcttgataaccggcgatcctccgaatcaattttatattcgttcattttcgagggagctgtctttaccgtaccactactctttttactgtccccagcaactgtttttttctcttcggcagcctctgccttccgtttggcctcagccttacgacgagcttcctcttctgccctcttgcgggcgttctctatttcaatcgcaatcagccgatcaatctgtgcattcaacttgttggcagagcgacgtttcgccgaaatttcagactgaatgctccgttgtttcttctgcaaagaggcaagcagcgttttacgttctttctcctgctcttccaattttaaccgttcagtctctccctgcttcaacatctcctctttggcatttttgctggcaagcaatatttgttgcttttctgtaacctgtttttgcttacgctccgcctgaataccttgtaggcgctgatagtcagcatactcacgaacataccgcagccgccggtacatctggctcaagttatcggcagaaaaaataaacatcagtttttcctgtatcgatttattgcgatacatatactttaccgactgctcatactttttctttttatctgccagttcccgctgcaaagccttcagctccagctgcagacgatcaacctctgcttgtatgaccttgacatctttttcaatcgtctcaatatatttcttgcgttcattaatctgtcctgatagtaaagctaaattattcagctggcttttcacatccttcttagtcgactgcaacaatgtttcggatgcggaaatctgcttctgcaactcagcatgctgcttttccagttcccgaatcttacgtgtgctctgcgcaaatccttgtgcacaaagcagacagaccaataacaacccaagtaattgtttcattgtttcaacaaagtctttatcagttcctgcaattcaatctgctgataacgggacgaaagctgtgtccgtccttcccaatctccacctaccgacaaacgggaaaacttcatgtcaagcgtaagaggtttgcccgtcccttctacagaaagcaacatgtgactgggaaacaaacgattgtccaacgtcgtaaaatcatcatatttccagttaagtgcatagggagtattcgaaaccccaatacaactttcttccagcaagccacggtcggcagaagtgcggaaacaataggaaagccctttggctggctttgcttccagcaagacacatccattttccagtgaaatacggaaagattttgcatcagagacatccaactgcgccttccctggaaggaacagctcattcaaaaacagagactgaagcacattaaaactcagttctgtatttgccagacgactaagttcctcaaatgaaaccttgacatagcgtttattcagtcggtcgacagccaacaacccctcgggagtaatttccagacgagccacctcgatacccagcaacggagccacatacaactgtatagattctcctcttttcaagcgcaacgtagcactgacttttgtatctttctgaccgtccatgttcagagtcaatgccacttttccactaactgccttccacgaaggcgaaagttctatgaccttctccatatacgcctcccctgtcagccctccaatcataggtgtcttttccagttttcgggtagacgaacacgaagctaccagtacaatagctaccagcacatacagatatcgtattaccaatcttatcattcggctatatatttcttttgagcaatcttttgtttcaagcgtttcttttctttttctgtaggcggagtagaaccgtcttcgggagtttcatccatcgcatctgctttcttccagtactccaaagccttatccttttcacccagcatgtaatagatatccccggcatgctccactatggtccggcttttatctcccttattacgcaaagcctgttcaatatagatacgtgcttcggtatatcttcccttttcgaacaaaatccacgcataggtatcgagataagtttcattatctggctcagccttcacggtacgataactcatctcttctgccttatccaaatccttccgttccacagaaagaaaataagcataattattcagtgtaccgatattgtccggattgtacaccaaagaagaatcataagcagcatatgcctcagcatgcatttccttcgagtgatacaaatcacccaatattgcgtagaaatcagacacaacacccttgtcacttttttcatttatctgcttcactcctttggtaaagacatccagcgcctcatcggtctctcctttctgatgataggctattcccagataataatagaattcaagcgactccggattgtactccagtgcaggcttcgctatccgaatgacatcatcgagattattgtcgcgtatggcataactcagcagctgaaggcgtgccggcttgttctccggatcgagttccaatatctgatgcaatacaggaacagcctctttctccattttctttgccagcagatattgcgcacacaacattgccagatcggcattctgctgcggacgtttcagaatgttctgaaacagagaaataacctgcgtgctatccttggagccttgctccgactgaaggataagctgacgcataatttccatcttggtatccgactgcacatcatcattcagtaaaatcgtatcaagttgcgcctgatataaactatcttgtccagttttctgataataagaagccatcgagatcaaagccggagcatatccgggctcttctttcaagatacgctgataaacgccaagtgcttcctgaggcttgtcgttgttcagatagacatctcccaatattgtctggtaacgcatatcgtaaggatattctttagacaagctttctatctccgtaaatgctttctcctgatcacccaacagcaaaaacattcggaatttttccatactaatctgttcggactttccatccagttcctccagacgattcaatgtattgataacctgctgataacttttagtctgattatacaaatctatcaatgacatcaacggttctagacgtgaaggaaactgatcggccatattttcataaaccgcaattgctttaggcacatcacgtttccgctcatagtaagaagctaatgtctgtttataccagaaattagattcatcagaaaacactgcctgttttaaagccagttctccttttctttcctgacccagatacatataaaactgcgagagttcatacaaggcagcccccgatgccggataaatatccaggcaatgctgatacaactcgtaagccgcatcgtaatcgcctttttgcttcatgcgtacagcctcgagaaaataatagtcgtacttccgccgttgctcaggagtaagcgggtccttttgtacgacaacctgctgatgcttcaacttggtctgtttgccggaagttccgcaagcaaccataaccaccatcacacaggccgatatgatataaatcaattttcgcataccgatgatttttttaataagcacgaacgattctccgttatttcactcccgtatgtccgaagccacccgctccacgttcagtatcttccagcacttccacttcctgccattcggcctgttcataacgggctatcaccatctgcgcaatgcgttccccgtcttctatcacgaaatcttcggtagaaaggtttactacaatcacgcctatctcgccacgataatcggcatcgattgtacccggcgtattcagcaacgttattccttttttcagagctagtccacttcgggggcgtatctgtgcctcaaatccttcgggcagggctatatataatccagtaggcacaagacaacgctgcaacggtttcaatactatcggttcctccaggttcgcacgtaaatccatccctgccgagcagtttgttgcatactggggcaatgcatgtttcgacttattgataatctgtactttcattttacggttattttaattgtgcgaagttaaacatttcgggggacttactatttatgtttaccattttttataaaaacaaatcttttatcagacaaaatctcccctttttcccactaggctgtcagtttttccagcgattttacctaagtttgcaaaaaactgtaaccaaccatgaactggaaacaactcatatcgaacaagcgtttcggactggaagctctgcatgaagtcaggaaagaagacagaaccgagtttcagcgcgactacgaccgcctgattttctccgcacctttccgccgcttgcagaataaaacccaggttttcccgttgcccggaagcatcttcgtccacaatcgtctgacacacagtctggaggtttcctgtgtaggacgttcactgggaaatgatgttgccatacgccttttacaaaagcatccggaactgtcggattcccacctgtcggaaatcggagccattgtttcggctgcctgtctggcacacgatttgggcaatccccctttcggacattcgggcgaaaaagccatcggtacctatttctccgaaggtaaaggacttgccttgaagccactgttatcggaagccgaatgggaagacctgattcactttgaaggaaatgccaatgctttccgcctgctgactcatcaatttcagggaagacgaccggggggattcgtcatgacgtatgctaccctcgcttctattgtcaaatatccgtattcctcacaactggcgggaaagaaacagaaattcggtttttttcaaagtgaggaagccgactacaaacggattgcagacgaattgggcattatcagactgagcaaagaaaacgagcccgcacgctacgcacgccatccgctggtttacctggtagaagccgccgacgatatctgctaccagatgatggatatagaagatgcccataaactgaaaatactgaccacacaagaaaccaaggagctgtactttcagttttttacggaagcccgcaagaagcgtattcacgaaatatgccagctggttacagataccaacgaacagatagcttatctgcgcacatctgccataggcgtgctgatacaagcatgtacgcaagtctttgtagacaatgaagaacagattctttccggtaccttcgaggggccgctcatcaagcacatggacgaaccgatacggaaagcatacgcaaactgttcaaagacggccttcgctaaaatctactgttcgaaggacgtcctcgatatagaacttgccggttaccaggtcatcaccaccttaatcgacctgatgatagaagctgtacgataccccgacaaggcttattccaagctgctcatcaaccgtgtttcgaaacaatacgaggtacacgcacccaccttgtacgggaaaatacaagccgtactcgattacatatcaggcatgaccgacgtatatgcgctcgatttataccgcaagataaacggaaacagcctgccagctgtttaaaaccgcccgtaaaaactccttatacagacaaagccagctccatgcctaacatcctttcgggacaaacgcacagagctggctttaaaatttttattcgtttatatcaatgcgaactttttgagaccaccggattagctcccgaagttatctgaagtgcttccggatgttccttgatataggattcaatgtgacgaatacgcttctcttccagaatctcatctacggcaatcaggataccggtttcctccacatcaccaaaaccgtcgttgatagctgtaccaaacatacgcatggtaggcgacaaactcatataagcatttaccaaaggaggaatattataccccaatttacgaacttctgaattcaaaactttataatcttccttgaacgtatcgtagcagaacagtttctccaaaacagctggatctgtttcaatttccaacggaatcatcggagtaatcaaaccatccttgtcagaaaaatgcttcttcagaaagaagagaatcatatcacgtccaaagcggttgtagctggggtacatcgtcatcttgccaaagaaatatttcacattcgacttgataaccgtcaaggcacccagtccgtcccacaaattatcgagagcaaaaagccctttcgatcctgcccgggtagactgatactccagtgttacaaacgaacgtcctagttcgatggtagtaggaagatattccttcagaaatttttctgaaaaattaaacatgtgagcggttgccagcacaggctttccttccttgtcaaattcaacttcatcacccaaaatatatcgatagcctcccagaatttcttctgcatctgggttccatacaatcaattgttggtaaggattttccatcaagtcatactcgtccaagtctaacgcctttcccgtaccacctccggcagcacggaaagctatctcacgcaaacggcctatctccttcaaaacattaggagcattcttccagtttactatatagatttcgttatggcttttattagtcgatcttaatcgcctttcagcagtaagttccgacttaagcaactctctatcaacaggtgcaataatttcttccatatatgtaataaaatcttcctaaattatagtttatagaccacatctctgacgtattcagcccactcagccggagatttggacttgtcgaatgtatgccatggtataggctttccaatcgtcacccgaaatgttttatgccggttcttaaacatctcgtctgccagatacagcatggcgatattgaactttatacaaaaaaacttacaggcattggcaagattgtagaaaaaattagaattccggccttcaaaatgtataggcacgacatagcgctgggtttcaacactcttggtaatgaacgtttttttccatgccaggtcctttataacaccatgctgacgacgggagcatatcccggcgggaaacataatgatatggctgtcggaacggaatccctcttccaccatgcgaggaaaatcacgcgactgcgatccggtcttgttgataggaatacagagcggagccagaccatgcagattcatcagcaaatcgttgaccagatacttgatgcgtccgttataatgtgtacccagcaaataccccagtgcaacaccgtcctgcccacccagcggatggttcgatacaaatgtgcaaagtccgtcttccggcaaattctccagtccgtgcacatccagctttgcatccagaaagtccatgcatgcagccagaaaatccactccgcttttatcccttacactcttcaggaaagcgtttatctcttcctgatgcacgatatgtttcaggtaagaaacaaaaaaacgaggaatccgtctggcttttttcccagccttctctttcaagattttatcaatatctattaaaaaaatcgaatcgctagccattatttcattctcacatttctttgcaaatgtaatctatctttcggaatgttgctcatttatatcgaaaaaatgtaacatggaaacctgaaaaaaaggacacaacgaattaaaatgtaacataattgcacaatatagcaatcggatgtgcacattttttcttttctccggcagatttattacaaagaagcatttgtcacaaagtcaatgccttgacgttcctgttgaaatttgtacaaattctaattttttttgtacaaattttctcaaaacatagagacgttttttcccaaatacgccgacgtttttcaatatcgtcccggtatttcacaacaacgtccttacctgttgataacttccttaaatattttcattcaactataccttctaattgttgagaaatatgtaattttaccagctcaatatatataaggtgtaaaaccgattaaagcaacagcattataatgaacgaaacagaacagatttatcatataccggtactgctgaacgaaagcatcgacggcatgaaccttcatccggcaggcatttatgtagacatgacgtttggaggtggaggacactctaaagaaatcctgcgacgtatggatgccgacagccacctgtacagcttcgatcaggatgaagatgccgaaaagaacattgtcgacgactcgcggttcactttcgtacgaagcaacttccgctaccttcataatttcctccgctactacggagtggaggaagtagatgctatacttgccgacttaggtgtatcatcgcatcacttcgacgactcggaacgtggtttctccttccggttcgacggtaatcttgacatgcgcatgaacaagcgtgcaggaatgacagctgccgacatcgtaaacacttacgaggaagaacgactggctaatgtattctacttgtacggagaactgaaaaacagccgcaagctggcttctgttctggtcaaggcacgcactcagaagcagtttgtcaccatcggtgactttctggaagtgataaagcccttgttcggcagagaacgcgaaaagaaagagctcgccaaagtctttcaggcactgcgcatagaggtaaaccaggaaatggaagcgctgaaggaaatgctttatgcagcaaccgaagcactgaagccgggaggacgactggttatcattacataccattcgctggaagaccgtatcgtaaaaaaccttatcaagacgggcaacgtagaaggtaaggtggaacaggatttttatggtaacgtacaaagtcctttccgtgcagtgaacaacaaggtgattgtcccttcggacgaggaaatagcccggaaccctcggtcacggagtgcaaaattacgaattgcagaaaaaaaatagttcaaatcatggagcagcaagatacaacatcacaacaacaagactcttcacatattacgctgaagagcattctgggaggcgatattttggcccacgactttttgagaaggcaggctaacctccttattctgattgtcattctgactatcttgtacattgacaaccgctattccagccagcaagaattaattgaaatagacaagctaaaaaaagaactgacagacatcaaatacgatgcgctgaccatttcctctgagctgacggaacgaagtcgccagtcgcatatagaagaatatatagcaaccgagggtactccgctacaaacagcgacaactcctccatacctgattaaaaaagaagacgaaaagaaatgatacccggactgaaaaatatcatgctacgttacacgtttatcgtagtaattatgtttgtattggctgtactgattatagtcaaagcgggatttatcatgtttgccgaacgacaatactggaaagatgttgccgaccgtttcgtgaaagaaaacgtagttgtgcttccaactcgcggaaacatcatttcttccgacgggaaactgatggcaagcagtctgcccgaataccgtatctacatggatttccgtgccggaggtgaggaaaaagacactatgctgatgaaccatctgtcagaaatcagccagggacttcacgagatttttccagacaagagtgcacaagaattccgcaagcatttgttaaaagggcgccgttctaaaagccgtcactacctgatttaccctaaacgaatctcatacattgagtataaggaagtgaaacgcctgcctgtattcgaactaagccccaatagaggtggcctgcacgtggaaacgttcaaccagcgtaagaagcctttcggatcactggctatgcgtacattaggagatatgtaccctgatatgacacaaggagccaaaaatggtctggaactgacttatgattctatcttaaggggacagaacggtatcacccatcgtcagaaggtgatgaacaaatacctgaacatcatagacaaacctgccgtagatggttgtgacattatcacgacaattgatgttgacatgcaggatattgccgagaaagcactggtcgaccagctgaaaactttggaagcaatatcgggtgtggcagtagtaatggaagtgaaaactggtgaagtgaaagcgaatgtaaatatgacacgtgccagcgacggcaactattatgagatgcgaaacgccgccgtaagcaacctgatggaaccgggttctactttcaagactgcctctattatggtagccatggaggacaaatatatcactcccgactatgaggtggataccggcaacggaatggtcaacatgtacggtagctggatgaaggactggaactggtacaaaggtggctatgggaaaatagacgtgaccaagattctggaggtttcgtcgaatgtcggtgtatcaaccatcatcgataagttctacaagaataatccacaaaaattcgtcgacgggctgaaacgaatgagtatcgatactccattgcatctgggtttcgtaggagaagccagtccgcgtatactcggaccgaaggaacgttattttgccaaaacaaccttaccctggatgagtatcggttacgaaacgatgattcctcctatttatattctgaacttctacaatgccatcgctaacgacggagtgatgatcaaaccgaagtttgtaaaggccatcgccaaggacggcgaaatactggaggaaatcccgacagaggttgtcaatccgaaaatctgttcggatacgacgttgaccatgatccgtaccatcttgcgcaaagtggtatcggaaggtcttgccaagccggcaggcagcaagcagttcaatgtatcgggtaagacaggtacagcccagatttctcagggtaaagccggatataaatctggaggtgtaagttatctggttagtttctgtggatacttcccttcggaagctccgaaatacagctgcatcgtatcaatacagattccgcacgggccggcatcgggaggtttgcaggcaggaagcgtattcagccgcatagccgaacgtatctacgccaaacacttgtaccgcgacctggctcatgctaaagattcgacggctgtactgataccggacgtaaagaatggagatatcaaggagtcggcatacgtcctgcgcgccctgaatataccggggaacagcaatacagttccttattctacggaaccgttatggggcaaagcacaatgtacgcacagctatgccgacctgaaaataagcaagccaagcaagcatcagataccgaatgtactgaacatgggagcaaaagatgcggtttacttactggaaagctacggactgaaggtacgacttatgggactgggcaaggttaaggcccaaagtattccggcaggttctccggttcgtaaaggacaaacaattacattaacattgaagcattagaaataacataaaaacatgaaactggaaaatatcattaaatccgtcaatgtctgcgaaaccaaaggtacggtagacaaagaaatcaaaggtattcagatggactctcgtctggtagaagccggacatttgtttgttgccgtaaagggaactcagaccgacggacatgcttatatagcaaaagctatcgagaaaggagctactgccattgtgtgtgaaacactgcctgaagagttgaacgagaacgttacttacgttactgttgccgatacggaagatgctgtaggcaagctggcaactactttctatggcgacccgacatcgaaactcgatctggtgggcgtgaccggaacgaatggaaaaacgactatcgccaccttattatataatatgttccgcaaattcagatataaggtaggtttgttgtccaccgtttgcaactatatcgacggtgaagccatcccgactgatcatactacccccgacccgattacgttgaaccgactgctgggacgtatggcagacgaaggttgtaaatatgcgtttatggaggtcagctcgcattctatcgcacagaaacgtatcggaggattgaaattcgtaggaggtatctttaccaatatcacacgcgaccatctggattatcataagactttcgagaattacctgaaagctaaaaaggcattcttcgacggactgcccaagacagcctttgcactgacgaacctggatgataaaaatggcagtgtcatggtacaaaacaccaaggcaaaggtggccacttattccctgcgtacactctgcgacttcaagggaaaggtactggaagacggattcgaaggtatgctgatggacataaacaatcgtgaagtcaacgtacagtttatcggacgtttcaacgcatcgaacctgctggctgtatatggagctgcgtgtctgctgggcaagcagcctgaagatgtattgcttatactgagtactctccgtccggttgccggacgctttgatgccttgcgctccaagagaggctatacggctatagtcgattacgctcatactcccgatgcattggtcaatgttctgaacgccatccatgaagtattgaaaggacggggacgagttatcacggtggtaggtgccggtggcaaccgcgataaaggtaaacgtccgttgatggctcaggaatcggtcaagcaaagtgaccgcgttatcatcacatccgataaccctcgttttgaagaacctcaggacattatcaacgatatgctggcagggctgacaaaagaggacatgacaaaggttctctccatcgccgaccgtaaggaagctatacgtacggcttgtatgctggcacaggcaggcgacgtaattctggttgctggaaaaggacatgaaaattatcaggaaataaaaggtgtaaaacaccatttcgatgacaaggaggtattaacagaaatttttgctaacgaataacaagaatacgacatgttatattatttattcaaatatttggaacagcttgactttccgggagcgcgtatgttcggctatgtttcgttccgctcgctcatggctatcattctgtctttacttatatcagccatatttggagagtatttcatcaagctgctcaagaaaaagcaaattacggaaacacagcgtgatgcttcaatcgatccgtttaatgtaaataaggtaggagtccctacgatggggggaatcatcatcatcgttgcggtactcatcccctgcctcctgctgggtaagctgaacaatatctatatgatactgatgctgattactacggtatggctgggcagcctgggatttgccgacgactatatcaaagtctttcgtaaggataaggaaggactgcacggcaagtttaagattatcggacaggtgggattgggattgattgtcggcctgactctttatctcagcccgaacgtagttatccgtgagaacgtggagattcagaaagacggccatgtggtagatgtggtgcacaaaagtcaggatgagaaatcaaccaaaaccactatccccttctttaagaacaacaacctggattatgccgactttgtaggatttctgggagaacatgcgcaaacagccggctggattgtctttgtgctggtaacaatctttgtggtaactgcggtttcaaacggtgccaacctgaacgatggaatggatggcatggcggccggaaactcagccatcatcggagtaaccctaggaatactagcatatgtatccagtcatatagagtatgccagctacctgaatatcatgtatattccggggagtgaggaactggtaatctttatctgtgccctcatcggagccttgattggttttctttggtacaacgccttccccgcacaggttttcatgggcgatacaggtagtctgaccatcggaggtatcattgcagtatttgcaatcatcatacataaagagttgttgattcctatattatgtggagttttccttgtagaaaacctgtcggttatccttcaggtaagatactttagaagcggcaagaagaaagggcttaagcgccgtatcttcaagcgtacgccgatacacgatcacttccgtacaaccttgtcacagcttgacccgaattgtacgtacctgattacttctcctacgagtgtgttccatgaatcgaagataaccgtccggttctggattgtcactattgtattagcagcaataacaattataactttaaagataagataacgcatcatggcaaaaagaattgtcattttaggagctggcgaaagcggtgcgggagcagccgtgctggcacagaaaaaaggtttcgatacctttgtttctgacatgtctttgataaaagacaaatacaagaacatgttgaacgaaagaggtattcagtgggaagaaggacatcacactgaagaattgattctgaacgcagacgaggttatcaagagtccgggtataccaaacgatgccccgttgattctgaaactgaaggaacagggaacccctattatttcagaaattgaatttgccggacgatataccaatgccaagatgatttgtatcaccggaagcaacggaaagacgacgactacttctcttatttatcatatctttaagaaagcggggttgaatgtcggactggctggaaacatcggacaaagcctagcttatcaggtggcagaatgcaactacgattattacgtcatcgagctaagcagcttccagttggataacatgtataagttccatgccaacattgctgtcttgatgaacatcactcctgaccatctggatcgttacgattacaagatgcagaactatgtggatgctaaattccgcatcatacagaaccagacagacaacgatgcttttatcttctggaatgatgatcctgtcatccaaaaggaattgcataaatatggaatacacggacgctattatcctttcgccgaaaagaaggaagaaggactggctgctttcgtagagcagaataaagtatacttcaccaagccgattgaattcaacatggagcaggaagaacttgcgctgacaggtacgcacaacttgttcaattcaatggctgccggtatctctgccaacatcgcaggtatccgcaaggaatgcatccgtgaagcactgagcgacttcaagggagtagaacatcgtctggaaaaagttacccgcgtgcgtggtgtggattacatcaacgactcaaaagcaaccaatgtgaactcttgctggtatgcattgagcagcatgaagaccaaaacggtcctgattctgggcggtaaggataaagggaacgattacaacgagatagcaggactggtaaaagaaaaatgctccggtctgatatttctaggtcttcacaacgaaaagcttcatgcctttttcgacggattcggcttacccattgccgatgtccagagcatgaaagatgcagtagacgctgcttaccacatggctaagaaaggagaaaccgtacttctcagtccatgttgtgccagcttcgacttgttcaagagttacgaagaccgtggtgaacagtttaaagagtgtgtgagaaacttataataaaaatatcctgggaaaatggatttgctaaaaaacttattcaaaggtgacaaagtaatttggataatctttctattgctttgccttgtttctattattgaagtattcagtgcttccagtacactgacttataaaagcggagatcactggaagcctatcaccatgcacatgatattgatggcggtaggagttgttgtagtactcattgcacacaatattccttgccgctggtttaaaacattcattgtattgttgcctttatcgtggctgatgctgatagctgtatttataataggagcactgaccaatggtgcaaagcgctggattgatttaggaatcatccagtttcagccttctgaagttgccaaaatggcaacaattatcaccgttgcgttcattttgtcgaaaatgcaggaagaaaagcaagcaaatccaaaagcatttaaatacattctgtgggttacatgcatcacctgcggacttattgtaacagaaaacctttcgactgcagttctgctggctggaagcgtttttctaatgatgtttataggcagagttcctttcaggcaattaggaatgcttgctggtatctgttgcggagttttagtattatccatcgctacaatcaaatatgtccctgctgaagcatgggataaagtgggacttcatcgtatggtaacttggcaaagccgtcttgataatcatttcaatacagcaactgtacctcctgaaaagtttgacattgatgctgacgcacagattgctcatgccaacatagcaatagcaaccagcaacattcttggaaaaggtccagggaacagtgtacagcgtgacttcctttcacaagcgtactccgacttcatttatgccatcatcatcgaagagctcggactgattggaggaggtgccgtagcctttctctacatatggctattgatgagaatagggaaaatagcccggaactgcgataaatcatactattcgtttttagtaatgggcataggtatactactggtaactcaagctatgttcaacatgctggtagcagtcggtattgtacctgtaacaggtcagcctcttcctttaatcagtaagggaggaactgccacacttgtaaactgtgcctatattggcattatactaagtattagccgccacgtcaatgaacttaagaaacaacaagagcaggaagaggcagaaaaacaacagcagatacaagatgcagcaatagctctattgcaaaatgctgcaactattgctcaagaacatgtgaataacgaatcagaacttaaagataaaacgtcaaaaaacgaataatattgattccttattctcgcttatatacagctaaataaatagaattggaataattatttttacaagtttattcctaactttgcaggaaaatataaaaatatgaaggataatttgaggattataatcagcggaggaggaactggcggacatatcttcccagctgtttctattgccaatgcaatcaaagaacagcatcctgacaccgaaattctgtttgtcggtgcagaagggcgcatggaaatgcagcgcgttccagccgcgggatataaaataataggtctgcccgtcgctggattcgacagaaaacacctactgaaaaatattagtgtacttataaaattactacgcagccagttaaaggcacgtcaaattatcaaagattttaagccacatgccgcagtaggagttggcggatatgccagcggaccaaccctaaaaatggctggaatgatgggtataccaacacttatacaagagcagaattcatatgccggagttactaataagttgcttgccaagaaggcgtgcaaaatatgtgtcgcctacgaaggcatggaacgtttcttcgataaagagaaaattatcctcacaggtaatcctgtccgccaggggctgctgaatcacaccctcagtcgtgaagaagccatccggtcgttcggactagacccacagaagaaaaccatcttgattatcggaggaagtctgggagcccgtactatcaacaactgtgtcatgcagggattggaaaagataaagaattcaggtgtacagtttatctggcagacgggtaaattctatatcaatgaagcaaaagcttgtgtggctcaggctgggaacctccccatgctatataccaccgactttatttctgatatggccgctgcatatagtgctgccgatctggttatcagccgtgccggagctggatccatctcagaattctgtctgctgcaaaagccagttattctggtaccctctccgaatgttgcggaagaccatcagacaaaaaatgcactggctttagtcaacaaggaagctgctttatatgttaaagattcagaggcgacacaaaagttgctcgatcttgccattgcaacagtaggacaagctgatacattaaccaaattaagtacaaacatcgctaagctggcttttaaagactctgcaaacgttatagcgaacgaagtctataaactggctgtcaattataaaaaagaacatgaacgttaatacattgaaagctgtttattttatcggagcaggaggtataggaatgagtgctctggttcgttactttttgtcgaaagggaaaaaggtaggtggctacgaccgtactccaagcgagctgaccgagaaactgattgaagagggagcagctattcattacgaagaaaacgtttcactcatcccgacagattatctgaatccggaaacgacactgattgtttatacaccagccattccggctgagcataaagaactcgtttacttccgtgaacatggatttgaaatccagaaacgtgcccaggtcttgggtatgcttacccgtacggaaaaaggactttgcgtagcgggaactcatggaaagacaactacctctaccatgactgcttacctgctggatcattctcacgtaggatgcaatgcctttctgggaggtatttccaaaaactatggtaccaatttgctattatccgagaaaagtgaatatgtcgttatagaggccgatgagttcgaccgttctttccactggctgactccgtatgcgacagtcatcacggctaccgattccgatcatctggacatctatggaacccatgaagcctatgtggaaagtttccgaaaatatacttccctgatacgtccggagggctttcttatcatgaaaaaaggaatagacctggttcctgacgtacagccgggagtgactgtatacacttattctacaaaagaaggcgattttcatgcagagaacatacggataggaaacggagagatcttcttcgattttatctccccactgggaaacatcaaagatatccagttaggagtacctgtgtatgtcaacatcgaaaatggaatagcggctatggctctggcacaaataggcggagctactcccgaagagataaaacaggctatgcccggattcaaaggcgtagaccgacgcttcgacttcaagctgaagaatgatcatatcgcattcatgagcgattatgcacatcatccggcagaaatcaaacagagcatttcttctgtacgcatgctttatccggacaaaaagattacggctattttccagcctcacttgtacacacgtactcgcgacttctacaaagattttgcagacagcctgtcattgcttgacgaggttatcttacttgatatttacccagcccgcgaacaaccgattgagggtgtaaccagcaagctgatatacgacaacttacgcccgggtatcgagaaaagcatgtgttccaaggaagagctgatggatgtcttgaaacataagaaaatagaagttctcattacgttgggagccggtgatatagaaaattatgttccacaaatatacgaattactgaaagacaaatgatgaaacgaattctcatactctgtgctttagcattggtagcagcttatcttgtactggctgttaccacattcaacagcaagcctgatgacagggtttgcaagggtatggaattgactgttaaagatagcgtcgactatggttttgtcactcaaaaggagattacaaatattctgaaaaggaaaaagatagatcccgaagggaaagaactggtaaacatcaatgtccgccagttggaaaaagccctttcaaatcatcctttcattgagcatgcagaatgttatctgacttccggaggaaaggtcgccattgatatctatcaacgagtacctgtcatgcgagtgatgagcagcaacggcgacgattactatctggacaatgccgggaagataatgaatgctccaggcaaatcagtacatgtagtcgtagcaactggattcatcgaccgcaagtttgcccaaaacgaattatatccattaggcaaattcttgcagggagataagttctgggagtcacagatagaacagataaacgtaactcccaaacaagagctggaattggttccccgagtaggcgatcacatactctttttgggaaaaccaggcgattataaagaaaaattcagtaaattgcaaacattctacaaaagcgcgctgaaccgggtaggatggaacaagtacgaacggatcagcatagaatttaacaatcagattatttgtaccaaaaaggagaagtaagatatggcagcaacagactttatagcagcaatagaactgggatcggcaaaaataacaggcattgcaggaaagaagaatgcagatggaagcattcaggttctcgcttatgccagtgaacgttcatccgattgtatcaagaaaggaactatctacaatctggacaaaacgactcagtgcctcaccgcagttatcagccaactggaagagacattacacgcatccatcaagaaggtatatgtaggtatcggaggacagtcggtaagaagtattcggaatacagaaacaaaacaactgacggaagaaaccaaaatatcccaggctctgattgatgccatgatggaaaataaccgagacattgccctgatggatcaggagattctggctgtcgaacctcaggaatataaaatcgggaacaaccagcttacaaccgaacctgttggtatccagacagaccgcatagaaggaaactttctgaatatcataggccgcaactccttgaagagcaatatccgccaatgtttccgccaagctggatacgaagtagccgaatacttgctttctccactggctacagccaatgcagtactgaccggaagcgagaaacgttccggatgtgcactcgttgattttggtgcagataccacaaccgtatcggtatacaagaacaatatgctgcgccaccttgccgtcattccattgggaagcaacaatattaccaaggatatttgcagtctccaaatcgaagaggaagatgccgaacaactgaaacttcattatgccagtgcttatacagagccgacagacaacgatgacgagttgagcaaagaatatagcattgatggaaaatgtaccatccgcgcccataaactggaggatatcgtcgaggcccgagtaaaagagattctggaaaatgtatggaaccagattatcttatctgaatacagcgacaagttacttgccggaatcatcctgacaggaggagcatcgaaactgcctaatctggataaggctctcttcaatatcaccaaaatagagaagatacgtattgcccaaaacagtaacgttgagctaagaggtgatattactattccacaagatggcagcagcaacaccttgatcgggctcttagctacaggcaaagacaactgttgtaaaattgatccccgcaaaggtcatcaactggactttatcgatgacttgcagaagaaagaggaagaagctcgcctgaaagcagaggcagaacgtaaggctgccgaagaaaaggctgcaaaagaagcagaggctgaaagactccgtcagttggaagaagccaaggcacgtcaggaacaggaacgtgcacaaaagcgtttacacgactgcgaaaccctgattacggaagcaacccgccagatgaaccgcaagaaatacaaagatgcactggcgaaactggaacaggcacgcagcctgaatgtgcaggaaaaggaagaagaaattgcatccctgactgccgaaatagaaaaattgaaagaagacaatccgttcaaacgactaataaatgcactcaagaacggagccgacgagatgatgaaagattaatattcaccgcataaagaaaaggaagaattatgtctgacgaaaaaattatgccattcgatttccaaagtggaacaccgagtatcattaaagttatcggtgtaggcggtggcggcggtaacgcagtcaaccacatgtacagagaaggtatccacgacgttacattcgtggtttgcaatacagataatcaggcactcgatgaatcgcctgtacctattaaacttcagttgggacacgaaggtctgggagcgggaaaccgtccggaacgtgcacgcgatgcagccaacgaaagtctggaagatatcaagcaaatgctgaacgacggctgtaagatggccttcatcactgccggtatgggaggaggaaccggaaccggagccgcacctatcatcgcaaagacagcaaaagacatgggtatacttacagtcggcattgtcacaataccgttcctgttcgaaggaaaccgtaagatagaccaggcgctcgacggtgtagaagaaatgagcaagcacgtagatgccctgctggtaatcaacaatgaacgcctgcgcgacgtgtattctgacctgagcgtaatgaacgctttcggaaaagccgacgacacactttctgtcgctgccaagagtattgccgaaatcattacgatacgtggtaagatcaacctcgacttcaacgatgtgaagaccgtattgaaagacggaggtgtagccatcatgagtaccggatatggtgaaggagaaggacgagtaacacaagccatcactgatgccctccattctccgttactgaacaacaacgatattttcaactcgaaaaaggttcttttcaacatctcttacagcatgaacagcgacctgatgatggaagaaatgaacgaggtacacgagttcatgagccgtttcggaaaggatgtagaaaccaaatggggtttgtacattgacgacagcctgggcgaaaaagtgaaatttactattcttgctactggattcggcatcaaagacgtgccgggcatgagcaacaagctttctgccgaagagcaaaagcgcctggaagaacaggaagaagaagaacagaaaaaggcagaacgccgtgacgacttctatccgggcagctacaaaaacagcagaaagaaaggaaactataaaatctatatcttcacacaggaagacctggataacgatgatatcatcagcatggtggaaacaaccccaacctacaaacgctcgaaggctgtactggaaagcatccagtcgagagcggttgccgaggaaagttcgatgcctaagctggataacaatgacaacggttccatgactattactttctaagaccgataaacaaccaataatttataataacatacgactatggacttatttgaacaaatcagcaacgatattaaagaggctatgaaagccaaggacaaagtcagactggaaactttgcgtaacataaagaaatgctttctcgaagcaaagacagctccgggtgcaaacgatacactgactgacgatgcagctttgaaaatcatgcagaagctggtaaaacagggaaaagattctgcggctgtatacgaagggcaaggacgtgccgacctggctgaagaagaaatggctcaggtacgcgtcatcgaaacttaccttccgaaacaactttcggcagaagagctggaagctaaactgaaagaaatcatcgctcgtgtaggtgctaccagcggaaaagacatgggtaaggtgatgggcgttgccagcaaggaactggctggtcttgccgaaggacgtgctatttctgcaaaagtaaaagaattattgcagtaagcaggcaaaggtatattcattatactatcgcataaactgcaagacaaaataaaggtaaacaagatacggaaccccacaaaggttccgtatttttttagggacattcagtaaataatataaaattagccaactaattcatacacaaagtgttgcgaattagctggcttttttgtatctttaggtattcccccgcaaataaggtttggcagccaaaacgggggaaattccccaaccaagatatggcaaaagtacaaaatatttcagaaattcagcctgctttgggctttacagaatttgatattctggaaaaataccgcaagagttttaacgagagtgagcttggcaggcttcactcggtgtttccgtttgagcgtatggcaaaagccttgggcctgttggaacagcgactgggacgcaggaacatcttcagccctgcggcaaagattgccctcatggtcctgaaggcatacaccggattctccgacagacagctggtggaacatctgaacggcaacatacactatcagatgttctgcggaatcatgatagacccgtccttccccataaccaactacaagatagtcagtgccatccgcaatgagatggcatcccgtcttgacattgaatccctccaggaagtgctggcctcacactggaaaccttatcttgagaaccttcacgtgtgcatgaccgatgctacatgctatgaaagccacatgcgtttcccgacagacatgaagctcctttgggaaagcctcgaatggctctacaggcatatctgcaagcattgcggggaacttggcataagacgtccccgcaacaaatatgatgatgttgccaaggcttatctgtcctactgtaagaaaagaaagagaaaggcatcaaggacaaggatgctcaagcgtcgtatgattagactccttgaaaaactcctcatgcagcgggatggaattcatagggagcatggagcctcactccggtatactcaggattaccggaagcggctttccatcatcagaaaggttcttgtacaggaaaagcaaatgtttgaaggacgaaaagtcagtgaccgcatcgtcagcattgaccgtcattatgtacgtcccatcgtaagaggtaaggaaacgaaatccgtcgagttcggtgcgaaggtaaacaacatacagatagacggcatatcgttcatcgaacacctctcgttcaaggctttcaacgaggggatacgcctgaaggactgcattcgcatgcagcagaaactcatgaacgtaagggtaagatgcgtggcagccgattccatatatgccaataacgccaacaggaagttctgcacgaaatacggaatctccacgtccttcgtacgcaagggaagggcggccagggatgaatccttgaggaaggttctcagaagtgaactctccaaagaaaggggcacccggcttgaaggcagtttcggcacacagaagcagcattactcgctctccagggtaaaggcacggaacaggaggacggaaatcctatggattttcttcggaatacatacggcaaatgccgtactgatgattgacaagatcaggaacaggacggttaaagcggcatgatatgattttactgacggaatcggaagaggtcatctggcttcttcagaagtgtcatgtcctgacggatagaattatgtgagaatacatggaaaaatgacaataaaaaatggcatatgaagatgatagaccataatcatttcatatgccatcttattttggggacatttactgaatatccctttttattctatcttccggatgcttccacctccggcaacagatatggctttctttccaattatccctgctcgcctcttccttcaagaaacccgacattccaatattttttgtacaaaaactaaaaacgtttgtacaaattttcagaaaacatgcagacgttttttgaaagataaaaggcagaagtcacgaaaacagcctcagctccctaccctgatgccaacaaccattttcaatcctccatcaaatcttgccctcaaaataactcctgcaagacaggaagagatttcaattccggaaaatccggcaaatgcaaacgataatattcattgataatatccagacaacggttacgttccatccggttcatggcaaacaagtgcatcgtttcgtagttcatacgcatcagattgcggatatgagaagcctcttccggacggacaaacatgccgtgataaggctgagagggtacaaaacaggcattcaacagatcgaaataatcgctgggagcgtaatcctccacattgggataaagaccgagaaagcgggacaagcgcatcagaaacaccagatgaaaattggcaaaattcgtttcgcatacatccagccactgcactgaatgcaccagataagcatacagcggaatgttggtcgtttcttccttcaaggcacgataaagaaactctgccagaaacatggcaatggccgacttataaggatcgtaaggcagggaggtaaaaatgtaccaagctttcgcttccttgatgggatgaagccccgaacgcggacgaacatccgcttcaaactccaccaccgacaaaggttgaaataacacctgcttcaccgccgatttgcgcgaacgctgagccggcagaaggaaagacatcctgcccgactgctcggtatatatatgtacgatattcgccttgtcgctatatttaaccgtatgaagtactatgcctacgtatttttgtaacataacgcagcaaagatacacaaaaacaaagaaacccctgcatgagaaatagatcaactatctccatgcagggaattgcattacctattaaaacgataagagagagaatccgtattaaaaaacattgacatcagtcactccggttagatactcatccaatcggttctcaatattacaaatgtaacaagctctcctttcgtacccaaattcaatcagcatcggaatagtacaaacaatcgttttcttaaactaaatgaacaaaaatcgtatctatcagaacaaaaaatacatacaaattcaggaaccagttctcttacaactacctacattccctatttttttatttcaaacactactccaactgattcagtctgcaacattattcgataaaaaaaacactcctacaccacgttgtgaatcataaaaaagaagtaagaaaaacaaaaatgggaacaaagaagagtagtcaaacagaaaatttagccagacactcagcaaaaaaatcaccgaaagttttgcaggaatgaaaaatcttcatacctttgcatccgcaatcgagagatatatatcctcgaagagccagtcaggtttaatcctgaatcgaaggatggcccgttcgtctatcggttaggacgcaagattttcattcttgaaaggggggttcgattcccccacgggctacataataaacaaaatcacgaacaatattaaagattagtcgagatggcaaatcacaaatcatctatcaaaagaatcagacaagaagaaaagagaagacttcacaacagatattatgctaagactatgcgtaacgcagtgaagaaacttcgtgcaactactgacaaagcagaagctgtagctctgttccctaacgtacagaaaatgttggataagttggcaaaacgtaacattatccacaagaacaaagctgctaacttgaagtctaaattggctgctcatatcagcaaattggcttaagtaattgctcactttaaggatattaaggctggatcgaaaggattcggccttttgtcgtttatagctacggcttatgacattccttccctcctgctcgtgactaagcgaaaaaaatgaagcctgtcagacctaaacgtaaacattcaggatatttgtaagtccacctccccttccggccaatgtgtcataccagacaactttaggcaaccccaaattccaccaaacctcaaccaacacgaaaaagctgcccagtaaaacagagaattacttctttctaaaaaaaagcattatattgcaatcgaaaagaaacatgcactttccgagaggtttagcttatccttcaaaaggacctgctaaaagcaaagactcgaaaaagttccgcaatccatctttcgtatcaccgataaataacctatgcttatgaaaaccacagtttctctccttctgcttgttactattcttctattgggaagcggatgcaaaaccacaaacgttgcgactaaaaaagtcagtcacgaacaagcaatgcaggcactggaacaacaccggttcaaaatcgtgatagaagaaatctacgacaaaagcacttccagaagacgcccgaagcaacgattcgcatccgactgctacttcagcatgcaaggcaatgagctttcttactacatctcacccgaagatataggcagccggaccaaaagatctccccggcatgaacacggactcacagccacactctctaaaggagaaaaacaaaagaacggagacatccattacgaattgaaaaccaatggagaagttacccgaatctccaccatgctgatcatcctttacaaggacaccaaccgatgtttcgtccgactgaccaaaagttttttaggcgccaactataactttacgggatacatattaccccagtaaagcatcccctcaaccgtggactgccgccggacccaaagacgacggcagcccgcgtcctgtctgccccgagaagaagcacggagcttccctatttcctgtcccattttcaagttttttagaaccataaactcggttatgtcacgcttttttagtaactttgaacacttaaaaaactagaagtaaaaagagatgagtgaagaactgataccaaacagcggaagcaattactcggcaagcagtatccaggtgttggaaggactggaagccgtacgtaaacgtcccgccatgtatatcggcgatattagtgaaaagggattgcaccatctggtgtacgaggtagtagacaactctatcgacgaagccctggccggttattgtacccatatagaagtaacaatcaacgaagacaattcaatcaccgtacaggataacggtcgtggtattcctgttgatttccaccagaaagaaaagaagtcggcactggaagtcgttatgaccgtactgcatgccggaggtaaattcgacaaaggctcctacaaagtatcaggaggtttgcacggtgttggtgtatcgtgtgtaaacgctctttctacacacatgacgacaaacgtattccgaaacggaaaagtctaccagcaggaatacgcttgtggtaagccgctttaccctgtaaaggaagtaggaacgaccgacattaccggtacccgacagactttctggcccgatgcaagcattttcaccactaccgaatataagtataatatccttcaggcacgtatgcgcgaactggcatacctgaacaaaggtattaccatcacgctgaccgacaagcgcgaaaaggaagaagatggctcgttcaaacaggaagtattccactcggaagaaggtgtaaaagagttcgtccgtttcctgaattcaacgaacactccgcttatcgacgacgtgatttacctgaacaccgaaaagcagggtattcctatcgaatgtgccatcatgtacaatacaggattccgcgagaacctgcattcgtatgtcaataacatcaacaccatagaaggtggtacgcacgaagccggattccgtatggcgctgacacgtgtactgaagaagtatgcggaagaaagcaaggcgctggaaaaggcaaaggtagaaatctcgggtgaggacttccgcgaaggactgattgccgttatctctgtaaaggtagcggaacctcagttcgaaggacagaccaagaccaaattaggtaacaacgaagtgagcggtgcggtcaatcaagccgtgggcgaagcactgacaaactatctggaagagcatccgaaagaagcgaaagcgattgtcgacaaggtggtacttgcagcaacagctcgtatcgctgcccgcaaggcacgcgaatcggtacagcgcaagagcccgatgggcggaggcggtcttcccggaaaacttgccgattgttcaagccgtacgccggaagaatgtgaactgttcctcgtcgagggtgactcggcaggtggttctgccaagcaaggacgcagccgccagttccaggctatcctgccgttgcgcggtaagatcttgaacgtagagaaagccatgtggcacaaggcattcgaaagcgatgaagtcaacaacatcattcaggcactgggtgtgcgtttcggtgtagacggaacagaagacagcaagaaagcgaacatcgacaagttgcgttacaacaaggtaatcatcatgaccgatgccgatgtcgatggttctcacatcgacaccctgatcatgactttgttctaccggtacatgcctgaagtaattcagggcggacatctttacattgccaacccgcctttgtacaaatgttcgaaaggtaaaatcagcgaatactgctataccgacgaagaacgtcaggctttcatgcagaaatatggcgacggaacagaaaacggtattcacacacagcgttacaaaggtttgggtgaaatgaatccggaacagttgtgggaaactaccatgaatccggaaacccgtattctgaaacaggtaagcattgaaaacgcagccgaagccgactatatcttctccatgctgatgggtgatgacgttgctccgcgccgtgaatttatcgagaaacatgctacctacgcaaacattgatgcgtagtgcatttttataaacttaatttttaaaatccatcctcgcatcttacaacgagggaagctccggaaactacttccggagcttttttatttccgtcaagtacctgcggaaccaaccgaaccgcctcatcggttttcattccgtctttcctttttgccctgcacagccgaaacaattcataaaaggatacaccccgatttgttccgaataaaaattatgctggggagaaaagagttttcggttttattcattacttttgaaaagacaataaaactaatacttcgaaacaaaatgaaactgatattccgaatccaataccgtacgttatggggggaagaagtccgcatcatcttcgatgaagacgaaagccagtcgattgccttgtctacccgcgacggtatcgaatggcaaggcagttgtgaataccaactgtcgccatgcgatactcccctgacctaccgttacgccatataccagaataatgcatgtacccgcaaggaactgggagcgattgctcacatcatttatccgggaaatgcccagcagagctgttacatcatagacgactgctggcgcgacctgccggaacataactaccggtacagttctgcattcaacaataaatatgttcctgccgctccggtacgcctgaacgacagtgtaggctgttgcatcacgtttcgtgcactttgcccgggattaagcagtcagcagcagtcgctcggtatcataggcagttgcaatgcgctgggcaactgggaatattgtcgtcctctccggatgcgtgaagtacgtcccaacgtatggcagctcacggtagacgcttcttctctgaaattcccgtttgaatacaagttcgtagctgtcagcaacaagaccggagccgtagtagaatgggaaacacggaacaaccgtatcttccacacccaaccgctgcaacgtggggaaacttactttccggcagaaacggaagtattcttccatacaccggaactgcgggttgccggatgtgctattccggtattctctctccgctcggaaggcaatttcggagtaggcgatttcggcgacctgaagatgttcatcacatgggcttccgatacgaaacagaaggtggtacagattctgcccatcaatgatacgacgatgaccaatacgtggatggattcatatccgtacaacagcatctctatttatgctttccaccccatgtacatcgacctgcgacagctccctgcattgaaggatgaagcggaaagcaaacgtttcgaagaagaacgtgtccgtctgaacgccctcccacaagtagactatgaacaagtcaaccagttgaaaagggagtatctgaagctgatattcgaacaagaagccgacaatattcttcactccgaagcatttgaggtattcttccgcgacaacaaagactggctcgtcccgtatgcagcatacagctacctgcgcgacttatatcgtacatccgattttaattactggggcgactacagcaagtacgacaaggaagagattctggagttatgtaatccggaaaaggaagaatatccggaaatagccttttattattttctccagtacgaactacacatacaactgcttgccacatccgattatgcaagaagcaaaggtgtcatcatcaaaggagatatacctatcggcatcagccgcaccagcgtagaagcgtgggtggaaccgtattatttcaacatgaacggacaggcaggtgctccgcccgatgttttttctaccaatggacagaactggggtatgcccacttacaactgggatgtaatggctaaagacaactatagctggtggcagaaacgcttccgcaagatggcggaatacttcacggcttaccgtatagaccatatcttaggcttcttccgcatctgggaaatcccgtatcattcgatacacggcctgctgggacagtttgtgccttcgcttccgatgagcaaggatgaaatacaaagtttcggagtacctttcgaccgtgaaaccatgactcgcccgttcatcaacgaatatattctgaatactatattcggagagcatagtgaagaagtaaaagaaacgtttgtcagacggctgcatcacgacatttacgtcatgcgtccggaatttgatacacaacggaaggtggaagcctactttgccgacaagacggatgctgagagtcaggacataaaggaaaaactttatgcactgatcagcgacgtgctctttattcccgaccgtgacaatccggaaatgtatcatccgcgaatcgccgtgcagaatgattatatcttcaagcaactgagggaacaggatcaggaggcattcaatcacctgtacaatcattattactaccagcgacacaatgagttctggtatcacgaagccatgaagaaactacctgtactgacgcaaagcacatcgatgctagtttgtggagaagacctcggcatggtgcccgactgcgttccctgggtaatgaaccagttgcagatattgtcgctcgaaatccagcgaatgcctaagagtccggcacacgaattcggacaggtacacgaatatcctttctactctgtctgcaccataggtactcacgacatgtcaacgttccgcggctggtgggaagaagataaggaaaagaccgaacgcttctaccatcaggaactgggacactggggagaggtccccgaacatgctccggcatggctgtgcgaggaggttatacgccagcatctggaaagcccctccatgctgtgtattctgacatggcaagactggacctcgatggacgataccctgcgcaatccgaatattgatattgagcgcatcaatattcctgccaatcctcgtcattactggcggtggcgtatgcatatcaccctggaagaactgatgaaacaggatgaattcaacgacaacatacgctccatgattgaggaaagtggaagaagtatttcttcagaaaaggaaaagaacgaagaataaaagaagaataccgatataagcatcggctacatgggtaaaaacgatatcgtaattccatccgaaaaaagaacatctcctacagataaaaagaaagaatcgtatcaccgctcgaaaacagagcctgatacgattctttcatcttttatagttaacaacccgtaacttttcaacaggattgtcaggagtttggtgtgtctcctgtcactgaattattctttgattcggatcagcaggttggcaaggatagccgtcaatccaccagttgtaatacccgaagagaagatattacgcaaagtgtcgggcaactgacacaggatgtcgggcaccagttccacactcagtccgaaagaaaagctcaaagccatgaccaacgtagccttacggtctatctgctgtgaggcaatgatacgaataccggcagcggcaactgtaccaaacatcaacaacgttgcacctccaagtacgggttctggcatcaacgagaacaccagtcccacagccgggaacagtcccagtataataaggaaacctgcgataaagtaacctacatagcggcttgccactccggtaagctgaatcataccgttgttctgcgcaaagatggaattaggaaatgaattgaagaaaccggccagcatcgagttgaatccatcggcaagaatacctcccgaagcacgttttacgaaagtttctccttctaccggctcaccggaaatcagtgaattggcagtgatgtccccgtatgcctcgatagccgtaatcagatacactaatgccagaccgatgattgaagaaatatcaaacgaaatgccataacggaaaggtatagggatattgaatccgccataactctgcactgccgaaaagtcaaccatacccagcgcccatgccgtaatatatccaatcaccagcccgataacgatagaactcatacgcagataacggttagaactacggttgaaaataataatcagaaccaataccagtgcggcaagtcccacatgctgtatggcaccaaacgttccatttgcctgagcaacggcaccacctccacaagcagaaatacctaccttaatcagactcataccgataagcgtaacgacaatacccgaaaccagcggagtaatgatacggcgggtatacttcaatacacggctaatcaacatttctacagaagacgctacgatacatgcgccaaaaatagtagaaagtcctcccgtcagtccggccgaaataatagggccgataaacgagaaactggttccttgaatacagagcagtccgcaaccgacagggcctaccctacgacattggataaaagtagagatacccgacgcaaacaaagccatcgaaaccagaaagccagttgtttccaaatcgagtttcaacgcgccggcaatgatcagcggaggagtaatgatggctacaaaaatagccagcaaatgctgtaaagcggcaaaaatcgtttctttcacaggcggacggtcattcagtccgtaaatcagccccgcacccggagccacagtctgttctttttccattaaaactaatactaacttatttgatggtgaaaaataaaaaaatgaagaaaccatgttgttgcaaacaatcatcgtttcttcatttttcccaattactcttttatcttaatttcacagtgatccaggctttcaatgatagccagcgactcgacatgaataccttgcgcacgcaagtaatcacctccatgctggaatgacttctcaatcaggaatcccataccaaccagttcggctccagctttctgtaccaggtcgataattccttttgctgcattaccgtttgcaaggaaatcgtcgatgaacaataccttatctcccggacacaaatagtcgctgctgacacacacttcgtacgaacggtccttcgtaaacgaatagacggtagtagtcagcatattttccattgtactaggtttcttctttttagcaaagacaaccggaagttcaagtaagtatcccaccataatggccggagcaataccactcgcttcaatagtcattactttattgatttttgtactggcaaaacggcgtacgaactccaccgccatcgatttcatcagaatcgggtccatctgatgattaataaagttatcaacttttaatattcctccctcaaaacatttaccatcgcgcaagatacgttccttgagtgccttcatataccaaaaagagctttaattgttttatatgttaaatattctgcaaagttatacgtttttatcctatttccggcaatgcttgagggagagatatttgttaaaaccgaaaattattcatctttcggtacatcatttacaataatatcttctgtttctccctctgtctgccagtcggaaacttcacttccttcaataatcagactttctttttctatttttatcttatatttataacaattacctccgactaaatgtcctttcattgcctcagtataagcctgataagcaattccgtcgcgttcatacgtaatcgagaatttcaatgttccatctgcttccgtaggattcagcaataccgcaatggaataaccttcctgaggaatgatagtcccttccgctcccatctccagcaaaagattgtcagcttccggtgcttctgctaccggctgcatctgtttttctgtaaaatcatacgtatgtttcgataaaatgcctttcccttcaaaagccaccgtcttgagggtcgtttcggcgtccttctcattctttaccagagtaaccattactaaactataaatatgtctgaaagctgcctcatcggtaaacgaaactttaccggcattagtctgataactacaggtctttttggctaccagaaaatcatattttccgatatgctccagttctccatcctgagtactcaagtcaggcatcggaatgcttgttcgttcggcttcctctgcatacggataaaaagcacaaaagctataatcatgtttctgatcgggccagaacaaaggtaccgatggctgccaggagctttcccccaatgtccataatacggcattcgtttcttctggcataaaaagcccgattttatcgccttgcacaaaagttgtatgcccatcttcctgagtagacgtacgtgaaaaaatctctccagcgatagaagcctgcaaacctaaagcaagattatcggttgaaatctcttctgataaattcccctgctggcatgatgtcagtactaaaacggccatgcacgaccatttcatccaatgtttcttcataatgataacttatttttaattaataaaatcactaatctttaacgcaaacagtataaaatttctaccgacatatttatttttattttatcctacttgcatatttctatcgaagaaccagaaatagacaagggaaagctgtcacagagatgtaaaagaatcgtagcagaaagacagaaagagaacggtttttaacatgtatttcacacaaatgagaaagaataatttctgctttacggaattatatcgtaagtttgtggcaaacaataatcagtaaaagacatgaagaaattttcattattactatcttttcttctcttcgtttcgttaggctttgcccagcaagcgaaatatgtattctatttcatcggtgatggaatgggagtaaatcaagtacaaggaaccgaattatatcggggggaactggaaggtaaaatcggaataactcctatctggtttactcaatttccttatgccacaacagctaccacattttccgcgacaaatggagtgaccgattctgctgctgccggtacagctcttgcttctggcaataagacaaaaaatggaacaattggtatgaagcaggatcagcagactgatgtcaatagtgttgccgtatgggcaaaaaacaaaggttgccgtgtaggtgtcaccaccagcgttagtgtagaccatgctactccggccgctttttatgcacacgaccccagtcgcggaagctattataaaataggaacggatttatataaagccggattcgacttttatgctggttccgattttctggatcctaccaataaagaggataaaagtggaacttcggaaaacctgtacaatctggcagaaaagaatggctataccattgccagaggttacaaggattacctgaaaaaatgcaagaaagcagataaaatgattttgttccagaccgaaaaagcatcggaagcagaccgtaccgctatcccatatgctatcgaccgtacaaaaaatgacctgacacttgccgatataactcgttctgccatcaatttcttgtcgaaagatttgtcaaaaggattcttcctgatggtagaaggaggtaaaatagactgggcgtgccacagcaacgatgccgctacagtattccacgaagttgtcgacatggacgaggctgtaaaggtagcttatgagttttattctcagcatccggacgaaacactcattgtagtaacagccgatcatgaaacaggtggatttgttcttggtacaggtgcctacaaattgaatctgcaagttttaaagaatcagaaggtgagcgagaacggatttacacgtattctgaacgaacttcgtaaaaagtacaacaataatgtttcttgggaaaaagtacaacaggcactgaaagaaaacttcggattctgggataaggtacagcttagcaaagcacaagaggaacgcttacaagcaaaatacactgaaacattcaaaggacaagaagcaaagctagaaaagagtgaatatgcacaagatgaacctcttgcagcagaagcaaaacggattatcgatgaaattgctcttgttggctggacaagtggcggacattctgccggatatgttcctgtgtttgccatcggagccggagctgaacagttccagggacgcattgacaatacagaaattcctgtgaaaatagcaaaagctgccggatatactcaggaataacaggtagcgacctatcactcaaaagataaataaggagctaatctcttaaggtctttctcagtaaactcctcgaacatggagagctgggaaagactttttatttttcctctcttccgacggtattccaaaattactttagccttatagaaatccatgtaaggatgtagctttaatttctccaacgaggctcggtttacctgaatcttttgtatctctccaaaagtgacagtaaaccatttgtttaatcctgcatctatatgaggaatttcctgcaactgagccacatcataaaatcctcccaagcgctgccgataggatacgatcatacgggccaacccactaccaatgccgggaatacgcttcagaaccgaagtgtcagccttattcaaatcgactacagttccttccggatatttaggaatataaggaactgtatctctgacttgtcgaaaagtatcagacacgactgtattaacttttaccggctcagcaatgacaatataaggcttcaaggcttgaaactgttcatcctgcaaaccatatatgcgtgagaaagactcgggcgaacgaaacactcctcccttttcccgatatttcaatatattacgaacaatgaaagcgggtaagcccaattggctcaatgtaagcgaatcggctgtattcgggtcaaaaggctgtaacacaacagcagtctcttttttcgcaaaagatggttggctatagctcttcttttctttccctctcaagctaatcaaaaaggaatcaatctcattactatccgaaagtcctaccggagctgaaggaggataaagccaatgtaaccctacccatactccaagcagcagcaaagcgataaacatcaaaagcaaaataaccctgcgctccgatttagaatagtaaaagaagtctttccacatctttatgttaacctaacagtccaagttcatttaagaatatcagaacaatgccaataggagctataaatttcaatatgaatataaaaacaggataatacggcgccttcaatgttccataattggttacttcatcacgaacaatctgacggtttatgatccaacctacaaatacggcagcaagcatacttcccaatggaagcataatcttggcagtcaaaaaatccaatgcatcgaataagttcattcccgcaatcgtacagctattccatacacccaatgccaatgatgaaactacgccaatcaaccagcagcatacagaaatgatacctgctgccttcttacgtgtaaagtggaatttctcatgtaaaaacgctgtagaaacttcgtgcaaggatattgtagaagtaagggctgccagtgccaacagcacgtaaaacaagatggaacaaatatatcccaagaaaggaataccactaaatgcccgttcgaacacgttaggcaaggtgataaaaataagcgaaggaccagcatcgggctctattccaaccgaaaatgcagccgggaaaattataagtccagctagtacagccacgcaagtatcaatcaatcctacactcatagcagtatttcccaaacgtgtctccttgccaaaataagatgcataggtcgacaagcatcccatacctagactcaaggagaagaaggcttgtcccattgcccctagaaaaacatccggagttaccttgctgaaatcgggagtcaacagaaactctatacctttttctgctcctggaagcatgacggaacacactgcaagaacgactaccaatataaaaagcaacggcataagtactttggaagaacgctcaattcctttctgtactccctttacgatcacaaaatgagttaacaacataaacacggtaagccagattaaaggacgaaaaggattctgcgaaaactgctggaacatagtcacaaaatcagcagatgacttaccatgaaactgtccggttgcagcttcaaaaacatattccaacgtccatcccgctactaccgaatagtatcccaatatcagaaaaccggttaaaacacccaaatagccgacccacttccaataacctttaggggccaaagctttaaatgcctcaccagtactggcttttgaatgacgaccgattgtaaattctgcaatcataatcggaagtccaaaaataaacacgcagcccagataaattaaaataaatacagcgccaccgtgattccctgtttcataagggaaacgccatatattccccaatccgacagccgaccccgcagctgccagaatcgctcccaatttactaccaaagcttacacgatcattatgatgcataaaattcttttttaattacagtttacacatttacagagcacaaaaatacaaaaaaatatcgtattttcgcataaaatataaaattcagaagctatgtattatttgaaaaactatccattatcagtgattataatcctcatcatttgctatttatccttctttactcctcccaagacagaactggacgaagtagcaaacatagacaaattagttcacatctgcatgtatggcggattaacaatggttatctggttcgagtatcttaaaaaacatcgtcagattatatggaagaaacttgctacgggaggaatcatctttcctatagccatgagcggatgtatcgaaatattacaggcgacctgtacgaccaatcgcagcggcgactggctcgacttcctagcgaactctctaggagtcggtttagcctgtctgttcagttactatataatccgtcctttagcaaaaaaacatttacaatagaaatgagaaactccgagaacttcccagcccccggagtcaatgaaaaacgttattaattatttttaaagatagagagttttcttgtgtttagcggaagtccttcagttcttcctgtaatttttgccgggtaaagtagatacggctcttaactgtccccagcggaagtcccaacttatcggcaatttcgcgatacttaaatcccgatacatacatcgagaacggtatacgatattctttcggcagcgcattcacaatgcgacgcatttcctttaagtcgtaggatccttctgtagaatcaccttctatatcgaaattctgattcagataatattgattgtcggtctggtctacataagtctgatcgcgcaatgccttccgataattattaataaagatattacgcatgattgtgtaaacccatcccttaaagtttgtttcggctgtatacttttcttcattgtccaacgctttcagcgaagtttcctgaagcaagtcatttgcttcttcgcaatctgctgtcaacttataagcaaaattcaatagttctgtctgaacgctcaacagatcctgagcaaaattagcagttctcatatttttataaatggtgtttgagattaatattcttgttttgttttgacactgcaatattagctcaaaaacgaacagccaatttcataaaatcaggtatgaaacaggggaatatctatcatataacagtttttacccccccttctgtgatagtttacaggtggtttttctaccagttcaagaaaaaattagctctatttccaggtggtatagggctctttcatcagaaaagaattataatatttaacctgccctgtcacttcttcaccaagaaaagcaggacgcaggaaagcttcttcctcggtagagagttctatttcggcgacaaccagtcctgcgttttcaccataaaactcatctacttcgaaagtatgtcctccaaaatttaccagataacgtgtcttatcaatgagcccgggttcgcaaagtttcatcaactcttccgcctcatcgagtgggatttctttctcccactcatagcggctcagccctgaatcattcgaaggtcccttgatggtaaggaaacccttttcatctcggacacgtactctgacagttcttccgcgggcactgcaaatatacccttgttttatccggcttttactttcagccaactggcgataagaatcatctttcaccaaaaacttacgttctatttcctgtgccattgcggtcgttgttttttaagacaatgaataaagagtcataatcaagacagccaaaataatcaggcctacacataaatactttatcaaacgatttgctttttcttcttcccgcttgctaaaatcctgtttcttgttatgtttcttagttcccatagctatagtatttagattaaacttttattttaaagataaaaaatttcaacaaaagctcacgaattcaactttttttaaacttcgctatccgagaattccatcagataagctttgatgaatccatctatcttgccatccattactccgtttacatccgaagtctgataattggtacgatggtcctttacgcggcggtcgtcgaaaacataactacgaatctgtgagccccattcgattttcttctttccggcctccaccttagcctgctcttccatacgatgctgcaactctttatcgtataagatagaacgcaactgacgcatcgcattttccttattcttcggctggtcacgagtttccgtattttcaatcaagatttcttcctcctcgccggtataaggatctttatactggtaacgcaaacgaacacccgactcaaccttattaacgttctgaccaccagcaccgccgcttcggaacgtatcccacgacaaacgggcaggttccacaacaacttcgatagaatcgtcaaccaatggagtgacgaatacggaagcaaaagaagtcattcgcttaccctgagcattataaggagaaacgcgcaccaaacgatgcacaccattttcacctttcagataaccataggcatacgcaccctcgatattcatggtcacagtcttgataccagcctcatcaccttcctgcaagtttgcaacagaaagcttatagccattgctctcagcccagcgcatatacatacgcatcagcatggaagcccagtcctgactctccgtaccacctgctcctgaattaatcttcagtacacagtccatctggtcggcttccgaacgaagcatattcttcagctccagttcttccagcgcatgcagagcctttgtatacgcctcttccacttcagcctcggtcaccagttcatccttataaaagtcgaaagccagttccagttcatctgtcaatgtcttaacattattatatccttcaatccatccttgcaagcctttcactttcttcatctgagcttcagcctttttcgcatcatcccagaaacccggcgcctgtgtacgaagctgctcctcttctacctgtaccttcttgttttctatatccagataacgataaagagcttcagtacgtgtctttacatcttttagctgttcaattgtaatcatatattgaatatcttatctttttattcgagttgcaaaattacatatttcgtctgtgaagtaaaaacaggaataaagattttagcccatttaccaggcagaatcttacatttcctgtaagtccctcactactcttcgtacattttttctatttcggcagcgtaattcttcatcagtaccggacgcttgatcttcagtgtattggtcagctcacccctttccatactgaacggttccggcaacaaggtaaaacgttttacttgttcataatgagcgaattcctgttgcaatgtatcaattctcaaacggaacaagtcgatgatttcctgtttctgaagcaaatccttcatatcggtatatgcaatatgatgtgcttctgcatactttttcacctgttcatattccggaacaatcaaggccgaaacaaacttccgctgatcggctatgatagatatctgatctatataacgatctacgaccaattttgtttcgatagcctgcggagcaatatactttccgttcgatgttttaaacaaatccttgatgcgttctgtcagatagaggaaaccatctttcaagtatccggcatcgcctgtatggaaccatccatcttccgtcagaacctgacgcgtcatagcttctttcttataatatccctttgtcacggtttcaccacgcaacaagatttcattgttctcgccaatcttgatttccagtcccggcattacacgcccaaccgagccgattcgaaaactatcgagccagcaacacgatacggtagccgtcgtttcagtcagaccatatcccgctatcatattgattcccaccgaatgaacgaattcttccacagccaacggaatggcagctcctgccgtaggaaaaaagtttccattctcgataccaagagtctttttcagcagactgtaaatcgtcttctcataaaacttatacttcatgtgaagcaagggaggaggtgtcttcccattcatcagataggtaatgttatgctccttacccactttcaaagcatccagcatcagccctctcttcagtcccgttgtttcattgatttttgcttggactccagcatacactttttcccaaaaacgaggaacactacacatagcggtaggacggatttccttgatggtcttctgtatatcctgcgggcgcaagttgacacacagagtacatcctttattgatgcaataatagctccatgcacgctcgaaaatatgggtaaaaggaagaaagttcatcaccacatccgcttcagtcaaagtctttaagcgctggtcatgagctgcaaacgccgcttcatagcatgaatgatgcaacatgactcccttcgactcgcccgtagtacccgaagtataaagaatgttggccaaatcgccgttccccgactccgaagtacgcttatccacctcttcctgatactttccatcttctcccagtttcagaaagtcggaaaaataaatagaatttttatcagcggccgaacgttttaccttcggatcgaatataataatctgcttcagcgacttacacaagttctgtacccgataagccacatcatactgatactgctcacccacaaacaagaaacggattcccgcatcttccagtatatagtgtacttgtgcttccgaactcgtggcatacagcgggatagtaaccacccggctgccgaaagcaccaaaatctgtatatagacattccggcatgttctgagaaaatatacccacattttcctgaacttccgttcctaaagcgatcaaagcgttcgaaacatttttgacttttgctgcaaactggttccacgaaacaggaatccagctttcggtttcatagtttcgatattttaaggctatgcggtcaccgtatttcttagcttgccgacatattaaggttgataaataagaattactcatttaaaatttagttattttattatcgctgaatgcaaagatagagtttaatttggaataaataaagtatctttgccgcacaaaacagaatctttttttatgttagacattggttattacacatccgaagcactgacactgcttcaggcattaatcggcattccttccatcagcagagaagaagaggctgctgccgattttttacaaaattacattgaggaaaccggcatcatgaccggacgctctggtaataacatctggtgtatcagcccgatgttcgacatccaacgtcctaccatattgctgaactctcacatagatacagtaaaacctgtcaacggctggcgcaaacagccttttacacctaagatggaaaacggcaagctctacggactaggaagcaacgatgccggcgccagtctggtttctctcttccaaacctaccgttacctatgcgctaccgaacagagttacaatctgatctttctggcttcctgcgaagaagaagtttccggcaagaacggaattgaaagcgttttgcatcagctgcctcctatcacactgggagttgtaggcgaacctaccgagatgaatccggccatagccgaaaaaggattaatggtactcgatgtaaccgcccgcggcaaagccggtcatgcggcacgcgaagaaggcgacaatgccatctacaaggtactggacgatatagaatggttccgaagcttccgcttcccgaaagaatcatccctgcttggtcccgtaaaaatgagtgtgacacagatcaatgcaggcacacagcataatgtagtgcccgacctgtgtaccttcgttgtcgatatccgcagcaacgagttttattccaacgaagaactgttcaaggagatttcctctcacatcagctgtgaagcaaaagcccgttcgttccgcctcaactcgtcacgcattgatgccgaccatccgtttgtgaaacgtgccgtcgaactgggtaaagtacctttcggctcacccacgctttccgaccaggcactcatgcctttcccctctgtaaaaatcgggccgggaaagtcttcacgctcacatacagccgacgaatacatcatggtaggagaaatagaagaagctatcggtacgtatatctccatactggacggattgaaactgtagtaaatcaactaaagaacagaaaacaatgaaattatccctaaagacattcaacctgctgggcctactggtaaccatattgttcttttccgcatgcggcagcagcaacaagaaccgtcaggaaagtgaaacagaaaaccagccgttagtaaaggctcccgattttaacgccgacagcgcttacctgtatgtcaaaaagcaggtagacttcggtccccgtgttccgaatacagcagcacaccgttcctgtggcgactatctagccaagcaactggaaagctttggagcaaaggtttataaccaatatgccgacctcatggcatacgacggtacgatgctgaaggcacgtaacataatcggagcctataatcccgatgccaagaaacgtgtactgctggccgctcactgggacagccgtccgtatgctgatgccgatgaagaaaagcaccatcatactcctatcgatggagccaatgacggagcaagcggcgtgggcgtattgctggaaatagcccgacacttacagcaacaggctcctgccatcggtatagacatcatcttcttcgacgcagaagattacggtatgcccgacttctacaaaggagattacaagtcagatacctggtgcctgggctcacaatattggggacgtattccgcatacacccgactacaaggcacgcttcggtattctgctcgacatggtaggaggcaaaaacgccacattctattacgagggatactccaagcgtacggccaaccagcccatgcagaagatttgggatatagcacacagcttgggatacacccagtatttcatcaaggacaacggtggagaagtgaccgacgatcacgtctatgtaaacaacttccgccagattccttgtgtagacatcatcgatttcagcccgaacagtccggacggattcaacccgacctggcatacgctgaacgacaatctggataacattgacaaggcaaccctgcaagccgtgggacaaaccgtcatgaccgttatctataacgaaaagtaactacaggaaaaacaaagactaaaagaaacaaaatatgaaaacaatcaacgaactccaagacgaagtgattgaagaattcagtgacttcgacgactggatggacaagtaccagttacttatcgacctgggaaacgaacaagaacctctcgatgaaaaatataaaacagagcaaaacctgatagacggttgccaaagccgtgtgtggcttcaggcagatctggtagacgggaaagtaatctttcaggcagaaagtgatgcactgattgtaaaaggtatcattactctgctgataaaggttgtatcgggacatacccccgacgaaatcttggactccgatctgtacttcatcgagaaaatcgggcttaaggaacacttgtcgcctacccgcagcaacggactcctcgccatggtaaagcagatgcgcatgtacgcgcttgctttcaaagccaaacaagaagaaggaaaattgtaatatactctcaagccaatgccattccttttgtctacggacgaaggaaatggcatttttcacattttatcagcaccttctctccatcggccagcgtggtagcaaacagataaacgtccccaccctccttcaacttcagctttttacggaggtcggccacagaagacggaaaattacgtaccgtcaggttggccttgtctacacccgccaaaaacgatttcaactccttcttgccgaatcctgataccgcaattacccggaagcagcgtccgggaaaatcaatctccgtatcggaagtatacagatgactgttgggatgaagcttctttaccccgtatcgttccgacaagatgcggtaagcccccgctttcagcaaggcagctcccggctcatacagatatccttccacctgttctgccatgacacacgaagcattgcgctcctgtgaaagcgtaaactccacatgttgatgaacaaagttattaacaacctgttcacaacttataactatctctttattagattgttcagaagataaatcttgttttttgaggataattatcaactctttgcactcgttattaacagccacaatgtgtatttcacgaacatgcttcagatcgttcaaagccgatgccatatcgagcataggcgaaagtttaatcattaccacccgtccccgctctatgagtagcggttcgagcgcgcacacattcggttcacaatcagcaatggccactgttttccctccatgactgtcgcgtcgtgccggatcgagaaacagacaatccaccggatccattgtccggagatactctgttccatcggcctgatgcacacggatatgtcctactcccagcaaaggaaagttatgccgtgccagttcgcacaacacctcctgccgctctacatagtcggcctgcctgaaccggcgggcaataaacgagcagtccactcccagcccagccgtcagatcggcaaacgtatcaccgccgaccagcgaagccttatagcgtgcagtcacttctgacgagcactgttccatcgacaaatgctgaggataacggataccttccgtctgagcccatgaaggcaccttcttttcggcaatctgccacccggctatctgcaccacagcttcggtcatatccacatcaggatatttaccagcctgcaaagcaagcaagcgaacatcgtcgtgacggtgctcatcaatgaaacgagaagtttcaggagatatttctttcattgcatatataaaaaaatatcccgcaaaaatcacaattttcgcgggatagaaattttaagacttgagcggtttaaaaaagtaaccaacccttaattaatattcttcctcgttgaagaaaaaatcttctttgctcggatagtccggccagatatcttctatgctttcgtagatttcatcttcatcttccatttcctgcaagttctcaattacttccatcggcgctcctgaacgcatagcatagtcgattaactcgtctttagttgcgggccatggcgcatcttccagttttgaggccaattccaatgtccagtacatagtatttaagttttaaaaagttttacattccaactattgagccacaaaagtataataaaatctttcatgtgcaactcttatcccaataaatttcatcatgttgtgttaattgatttaactttcgggatagaatgaacaaataatcggacaatctgttcacaaactgcttgacttccggatcaatttcacagctttcatgctcttcgagtgccagtattctacgctccgcacgacggcagacggtacggcagacatgacaaaacgaagccgaaagcgccccccgggaagtataaaggccgtcagtttaggcaacgacgcgtccagttcgtcgatagcctgctctagacgtgtcacgacttcagcagatatttgacttgcaacctgcaaatcggtagtcgactggtcggtagccagataggctcccagcgagaatagtttatgctgaatgtacagcaagaaactacggatctccgcatcgtcgacagaagcagccagtactcccagatttgcattcagctcgtctaccgtgccatacgcctcaaggcgtgcatgcgtcttggatacccgcattccccccaccagggaagtttttccagcgtcaccggttcttgtataaatcatacttttcttcatagtatacggtttatgttgttaaaggaaattcactatacgatgttcttttacccgtttcttatcgaaaaataccagcccgacatcgtagagatcgaacgttacccccgtacgagggtcactgataacttgcttccaccattcccgcttctctttcgtagcatacggcgaaccgataaaaaagcatgtatgcgaagaaacggcaggcagcaacgcttcgaaaacctccttgtaataaggagtgaaggctatatgtacgatatcgggacaaccatgctcttccacatagcgatgtaacaggtgaggcacatctccacagcgataatctacctgcggacagtctgccagcaagcgtattacttctccacggcattctccactatcgagcgtatacagcggaacatgtttcgcttcggccatatatcgtgccgacaatccgctgccggttcccacttcgagcatggcagcaggttgcagatagttgaccagccggaacagcagacggtccactttctcacgatagtgagataaactcaccacgtccttcctcttggcgtgcagcaggctataggcataaaaaggcagccgctcatacacgacaaaagttatcagaaagaaatcggacggtgaatgcactccgtatccacaacgatgacgaaagcgacggcaccagttccatccacgcaaaaacaggttcgacataaattcttttcttctttagtatggtgaacaaagatagagaaaaaaatattgccatccgatatttctcggatggcaataccctatagaactaaaaaaacaaccaagtttttttacttgcgtgcacccagtttatcgtccagatacaagataccggcatggtcgccacatttcttcagtttctcaacaataccctgagctgttgcttcttcctctacctgttcgcggacatatccccacaagaaatcctgagaagctttgtccttttcttcggaagcgacatttaccaattcgtctatcagttcagaaacatgacattcatgttgataaacatgttcgaatacctcgagcacactgccccatccctgcggaacaacgtctatcttatcaaccaaagcaacaccgccgcgttttgcaagatagtcggcaaggtcgtaagcatgctgcaactcttcttgtgactgcaacttcatccagtgtgcaaaaccatcgaaaccttctttcttcaaatagaaagacatggaaagatagagattagacgaccacatttctgctgcaatctgatcgttgattgctttttgtaatttttctgaaatcatgatatctaaattttaatggataataattttaacgtgagttcgatgaattataactatttgtaaatttggtgattagcgaaaattgttgtaactttatagtgttcaattacaaagtattacaaacaataatcgctatgatcaccgaggacaaagttacagaattattttgtatggcggacgacttctgcaagttttttgatgcaatgatggaaaaatatacgctgaaatcaggcaccaagcggcgttatcaccgcgattcgactatgtcaaaggcagaaatcatgttgattatgatattgttccatgactccggctaccgttgtctgaaacatttctatctggaaaaagtatgcagacatctgcgccacctcttcccaaagattgtttcatacaatcgttttgtggagcttgaaaaagaagtggcagtaccattggctcttttcattaagaaagtgttgcttggaaaatgcacaggcataagtttcgtggacagcaccccgttgcgggtatgcaggaatcaaaggatacatatccacaaggtattcaagggtatagcccaaaggggcaagtgttccatgggatggtttttcggtttcaaactgcatttgatatgtaacgagaaaggcgagctgctgaacttcatgataactccgggtgatgtcgatgacaggaaaccgttggagtataaggcgtttgtcgaattcatctacggaaagttggttgcagacaagggctatatcggcaagaacctcttccgacgcatgtttgttgacggtatacagcttattacaaaactcaaaagtaacatgaagggggctttgatgagtgtgtcggacaaattgctgcttaggaaacgggctattatagagacggtaaacgacgaattgaaaaacattgcgcaagtggagcattccagacacagaagctttgacaatttcatcgtaaacatactgggggcgattgcggcgtactgcatgtttccaaaaaagccgtgtatcaatgtacaacgtacatttgacacacagcttgctttgttttgaattcgtcgaattcacgttaattttattatttttccaacaaacgaaatgccagctatcttcttatcctactgatttttataaaaattaaactgtggaaatcaccttttatgagtttctgtcaagatgtcacgactacatagatccagaaaatcgtaaaggcttgacaaaaaggcacggttatgtcgggagcctcttatacgagccctgcggataaacagaaaaacataccgactgagttttgaaaaaacgtgccgaggttttttgaaaatttgtacaaacaaaaaaagtttttgtacaaatcatcgggtacttcacaggtgcttttttcaagacgccccgaagctgcccgaagttcctgaccgaaagtttttttgtatctcgtccgttaatcattattctgaacacgacaataaataaaaacagcgtgttatctttgtaactggataaacaaaagacaaatacaacaatgaacaaacttatcggttggacttccggtgccacccgcagcaacttcatgtttcacgtactggcactggctatagtcgcaatatggggaattacattcgtatcgacaaagatacttctgaaatcgggactaagcccttcggacattcttttttaccgatttgtgatggcatacatcggaatctgcttatgttccagacctttcaagctttttgcctatagcctgaaggatgaatttctgtgcttttccatcggactgctgggaggaactctttatttcattaccgaaaatacagccttgaagtataccttggtttcgaatgttgccctgatatgcagcaccactccgctgctgaccatgctgatacagtatctttttgtcaaacggacactgccttctggaaaaatcctcatgggctccattctggcttttgcgggcgtgggagcggtcattttcaacggcaagtttgtgctcaacctgaacccgacaggagatttgctttgtctggcctcagccttgtcgtggactttatatactttggtttccaagtatctgaccgacaaatatcccgccatgttcatcgtgcgcaagaccttcttttacggtctgctcacgctgattccttttctggccatgcagggttctctcacgacctcacctcacatcctgctacaaccgcaggtgtggagccagctcctctttctgggaatcgtggcttcgtttctttgcttcatgttgtggaatgtctgcctgcgaaaactgaacacaattgtcctgtcgaactatatctacctgattcccgtcatctccatatcggcttcgaatctcattttgggtgaaagcctaaatgctgtcattatcgcaggaaccgtgctggtaatcgttggaatgtactttgccgggaaataaaaaagaaggataagaagaaatatatctaaaagaaaaaagctaaataaccaattggttatctagctttttctttgtacccagacccggtacaaggcatagaaatcataggaaaataaaagaatttatcttccttattatcaattatttgcatctttcttattttctctatttttgccatattttgcccatttttcgtcattaagtacacttttagtacactttgaaattccattttcttttgtacctttgcaatatcggaaaacaaaagaaaatcaattatttagcgtaatcacccggttatggtacctaaatcgggataaaacctctaaacaatggcaaagttagaaaataaaacgaaagaaaaccctaaattggagcaaaacaggctgtcggacggcagaattagtttgtatctggagtattatttgggtagagaggaaaagcctgtattggatgaaaacggtaatcaggtgtattatgaaagcggtaagatgtggggaaagccgaagttcgctatcaagcatcacaggcgaaaagagaacctcagcctgtatctgatagagaagccacgtacccctgcggaacgccagcagaacaaggaaacactggagcttgctgtaaaaatacgtgccgaacgtgaacaggagtttaaggaaagtatgttgggctatcgcctgaaaaaagaccggaacgtgaatttcttggattattttcaagcctatatcaatgactataccaagaaagacattcggatggtgcaaatcgccctaagccgtttcaaggactttttgaaggaacattacccgatgcacgagttcggcatcaagccggaacttatcacgaaggacatgatggaacagttcgtagcttatctgcaatcccggagcgtgggcgaaggggctaaaagcatcttccaacgtttcaagaaggttatccactatgcgattgaccacgatgtgatgctgaaagacccctgcaaaggcgttacctgcaaggcggatagccagatactacgcaaggacgtgctttcgccggaagaaatccagcggttgattgcgtgccattatgacaacgagaaccccaacgtaaggcgtgcatttatcttttgcctgtattgtggcttgcgcttctgtgatgtgaaagaccttacctataagaatatcgactacgttaataagctgctaaaatttgagcagaacaagaccaaaggtcattccgccagtagcggtgtggtcattccgctcaatgacggtcttctttcgcttgtgggagaaccgccggcagacggtaacaaagacgctctcatcttcaacctgccttcgtatgaaagttgctgcaaatccgtcaagcgttgggtgaaaagagccgggatagataagcacataagctggcattgcgcccgtcactcattcgccgtgaatatcctcaacaatggggcgaacatcaagacggttgccagcctgctcgggcatagcggactgaaacatacggagaaatacacccgtgcggtggataaattgaaagaggaggcgataaacagcctgccggaattaaagttttaaccataaaagacttacctttgcaactatggactttgaagcattagtaaaacatatcagcacgatacaaagcacgttgcaggcgcaagccgcacacgctgtaaacctcgccctgactgcccgcaattggctcatgggctgctatatcgtggagtttgagcaaaacggtgaagaccgtgccgcatatggcgaacaactgttgaagaaactggaacagcggttgaatgtcaaaggactgaacgagcgcaggtttcgtgagttccggcggctataccttgtttatccgcaactgaaagagcctatcgcacaatacatattggcaggaagcgaaattcggcacacactgtccgccgaattcacagacccaattcggcacacggtgagtgccgaattacaatccgttaataatcaaccaagtgaatggaatacacaagctgatagattatttgaaagattaccgtattctcatttaaagtttatttctaaaatagaaaatccggtcaaacgtgctttctatgaaatggaagcaataaggggttgttggtcagcaagagaactggagcggcaaatcaattccctctattacgagcgcagcggattgtcgaaaaacaaagaagccttatctgctttggtgcaacggcaagccatgccgctgcagcccaaagacattattaacacgcctgttacgttggagttcttgggattgaacgaccgtgctttggtaacggaaagcgacttggagcaatccattctcgacaacctgcaacacttcctgttggaaatggggcatgggttctgcttcgaagcacgccaaaagagaatcctgatagacggggattatttctttgccgacctcgtgttttaccaccgcattttgaaatgccatgtcatcgtggaattgaagatagacaagttccgccacgaatacgcttcgcaactgaacctatatcttaactacttcaaggcggaagtgatgcaacccgacgacaatccgcctgtcggcatcctgctttgcaccgagaagggcgacacgttggtaaaatacgccactgccggattagacccgaacatcttcgtgcaaaagtatatgatagaacttcccactgaagaggaaattaagaagttcatttcaactgcaaactattagcaataaaaaacactactggcgaaaagaaggaaagccattctttctcttttcgccagcacgtttattactgccaacaagaataggtttaggttagtttggatgtatatacaaaagacagaactaaaccgtaaatgcagacgataattatagcaagtcacttatgatacattctgttcttccaagactatattagcatcattatcgcatttttcaggcttaatccgctctatacgacgaatatgttttgccctattagctataattaacggtacacgctcgacaacaacaaccgatgtgtcaagccccaacgcactcggttctccaatgcctatctttctaattaaggcataaaggctcatcagcaaattttgtcggcggttacgggaatcttcaggataatatatccggtggataataataaagcgaaaatcacccggtatgccattcttatgcaatgaaggataagagcttgttagttctacttcaccatccgcaacaaggtcatcaactacttgtcgtaaataaaggctcacgcgcggttctatacgaaaacctatacgcatggttatactaaacaatgtcccttttattaatgtggaacaattatattcaagtgtgtctggtgtatccacaaattcaaggttaataagccaataatgatctgcccgtttaggctgcttattaattatggaatacaacaatttatcgtccacacaaccttctttgtctgcatgattcacatagacaagattagaagcatatttggatatgctttcgtccgccttaatatcagaaataatgttgtagtattcacttaaccgtttggaagacatatgttttcgacgaattttgttggcacttacccatacaaacatgataaaacataataatccacctattaacagcgtaaaccaacctccgaccataaatttggacaggtttgcagcaaggaaaataccttcaataacacaatatccgccgacaaacagtattgatagaatgcgtggaatgttatgcatatgcaaatagaatcccaacaacaatgttgtcatcaacattgtaatagttatggcaagtccataagcggcttccatgtgggtggaatctcgaaacaacaatatagtaaatattactccaatatacattacaaggtttaccattggaataaatgactgaccttttacgttggtagggtgcttaatacgcatacgaggccagaaattcaagttcatagcttcactcaatatggaaaatgaaccgcttattagagcttggctcgcaacaatagctgccccggtagccattgctatggaaaacaacagtatttcttgtggcatgattgaataaaatgggttcactgtaccttctgcactttccggatgatgcaatacccacgctccttgccccaaataatttagaataagcatcacctttacaaatatccaactgaccgtaatatttcgtctgccacagtgccctaaatcagagtataaggcttctgcaccagtggtacacaagaaaacggcacccaatatcagaaaccagtggggggattccactaataaccgtatggcatagtaaggattgaatgccttgaatacttgaggataggaagtcagactgatagctccggcgattccaagaagcaggaaccaaagtagcataaatatgccaaatgaccgtcctatattttctgtaccaaaacgctgaacgaaaaatataatggtaataatggtcagtgtaataggaatcacaggcagatgcggactgatactttcaagtccttctatggcagttgtgaccgtaatggctggagtgataataccatcagcaagcaaagtgctcgcaccgataatggcaatgatgtaaatccaccttcttctgtggcggcgtaaaagggcataaagcgcaagtatgccaccctccccgttattgtcggcacggagagccaccagcacatatttcaccgtagtctgaagagtaagcgtccatatgatacaagacaatgcgcctaaaacataattttcatcaagagcttctccagtatgaatgatggctttcataacatagagtggcgatgttccaatgtcaccaaaaacaatacccaatgtgatgagtaacccggcaaatccaagtttatgttgaatattgccttcttttgataggtttgccataaaaagtagttttttgttctacatatatttgttttcctttcaagcggcgcaaatataaaataaaatcttaacaataagatttcacttttcttttttcgtgaaaaatatcatataaaccttgacgatggtcaaggcttgtctaaaaaaatagtctgtttgaattacgtataactattaaactcaaaagccgaagttatgggacttatccttcacctcggctttttgctatttactgatttcctaacctatcagcttcctttttcaactgctcagcctgctcattaagcagctttgcccgttccaaggcttccgcctgcctgcggcaacgttcctcaaaatctagtaccgaatccgtcaggttgcggataaaacgctcgtcccgctgccacttgaacttattctccagtctttcaagggtattgccgtccgcttgtccctgcatcagcagataacggtatttcatgtcgttgtcctgcaactgccccatccgttcagccagacggacattcaggaacagggacgtggcacagacaatcagacctgccgaaaagaggaatagcttcgggcgtaccaaagaagttactttgttgtaaatccgccgatgaaacggtacgggtttggcttcttctttttctgccatgcgctcatcatggtaccgcttcattgtttccagcatttccttgagacagccgaaagtggctactacataattcttgacctccccgaaagattgccgttgttcctgtcctgatttccgcagttcggcaagccgggtcaggatgtcttgcaactctttttcgggaaccgccgggtcctgcgtaactcagacaatgcccgttctatagcctccagtcgggaaagggtttcctcgcgtccggctggcgtcacctgcgcttcctgcttctccttcagttccgtgaccatggagagaagcccctctaaaatcaaattttcttccatatccgtttacagtttaagttgtcttttctttttcttcttcttttttctcagactccagtcaatttcttcgtccgatggagcagacggcgaaacatcgaacaagctgaacaagccgcccattgaagggctgtcgttcctttgcggtgtttgctcaggctccaaaataggtgcggaaactatctgctggctattttctacggtatccattcctgcgttcccgaaatgcttatccagtttggagaagctgaaattgcggtctatttccgaacctttgaacgtataggcacctttggtgaaggagatgccctgcacctcgtctgtacgccctttatacttgaagcggatgccgatgcccttttctgccagccgctcctgtaactgccgccaacttttggacttgccgatttcattcctcacagccgtgtaaatctcgtatttcgacttgtccggctctttcaggcgatgccgcttaaccagttccttgcctttggcgaagtatagcccgtgcttggctttcagcttcttgcacacctgctcgttgcggtacatgtcgttcctgtccgagatggtcttgccgttgttgtctatgcgattgaacacgatatgcacatgcggatgctccctgtcttggtggcgcacgatgatgtactgcgtatcggtgattttcatctctcgcatatactcttgcgcaagttgtatcatcttctcgtccgtcagcttgggcgcatcgtttaccgaatagctcagcgcgatatgtccgactggcttgcccagacggggattcatggaggcttgtgcgcagaagcagcggatgatgtcctgcctgctttccgccagtactccgtctgcatggagcaagaccgcctgctgcttgcccagcacgtagtccacacagcccttaaacccgcttcctttccttatttttccaatcatccgacaaatggcttatgatttccactatcctgttcttaagtttcaccagttcgaccgccactttcgcaaagcctccggcatttgcccggtgcgccagctggttgatgttgttcgcttcgcctgccagtttgcggaggatgtccgtatcctgcctgttcagccggggcgttatctctgccgacacgacagcctgccgcacatactcgctgacacgcagcccggcttctgatgcccgcttcctaacggcgtaatactgcaactcggtcagcttcgtgctgaccacacgtctttgcttgtctatccggttctttgccggacgaccgcctgatttgttccttgtatctgtcatacatttttgtctttggaagttgtcttgaaaattgcgaccgacgggagcggtttcctttgcggggagcaaagcaaggcggtttcggtctaccgaaacataaccttgcttcccctaagaaacgtctgcccgttgctcacagtgtctatctccgccgggttagattcccctgcctttcttctgccttagcagcagtttctgtccgtttttctgttcttgcttcctgccgcacaggtaatcgttcaggtcggaatattcccggtaattgtgcgagaaatcccgtacccgataggagtattccgctgtgatggcttgcgttgcccggatgcctgccccgtcattgtcgagcaggcagtggatgcgttcatactgccccaatgcgtcaatggctttctgtacattggcggtggagttgagtatgacgtaatcctgcctgtcaaggttgggcatgacagggcagttctttgtccttagcgtgaggaatgaaagataatccatgaagccttcgaacaccaggcacttctccctcggttcgccctgttgccggatatgggtgatgtctttcggggcgatgcagcctttgaaaaaggagttgcgcacctcgtagccgccagccacattcgggaaaccgatggcgaagtagggcttgccgtcatgagtgaaacgcagttccctgcattctctttttgccagtgtaaggtcaatgccacgcccctgcaagtaacggagcaatgccggatgggtgaggtcacggacttccaaatgttgaaaactcggtgccgacctttgctgccgaaaagaaaaactgaccgggcggacatgctgtgcctgttctgctatccggtttaagaggtacggcagatggtcggaacagtaaagttcctgtgccagtgcgatgatgttgccgcctttgccagccccgaagtcataccattgttcccgttctgtgtttactttaaaggatgcttcatgttcctccctcagtggcgatttgtaccatagattcgctccctgctgcttgacgggtgaatatcccagactgtgcaggtaatcggtgatgggtattttctttgcttcttcaatgttcataatgcaaactttttagtggatgatgaataattgggaagtgtaccagtccggtttagaccttcatatatacgcccgtactgtgccggacttgattgccgggagtgacgggaaacgggaagtctgttccccttatatatgtccgaactaaaccaaacctgttttagtagtgaaaatcgggattgtaacggtatccctttccttcctttacaatcatacgcttgttcacgaggaacgtgttcaatgccacgaggacatttcgtccccgctcgtagccgatgcttgcatagccctgcttcaacgcctgtatgacgttggaatagccctgcacggtgcgcttgccgaaaccgttttccaacgccgtgcggtgctgctgttcagtcagttccgtaagcggaaaacttttttcctgcttgggctgctggaatacatagccgtccacgacttcgggcaatgcgctgtcgttgatgcggaaggcgaaaggctcgaagtcccggtcgcgtatatgtgccgcctttacctcgctgatgttcccgtcctgcgtgctcttggtgatttgcaggacggtttccgccttgttgttcagttccgtgccgatatgtcccctcgtattgtcatcccccttgttcagatgcagcacggtatgaatgtgcaggttgtatccgcttgaccagcgcatgagcaggtttatcaggtcggtcgattcgctggggctgttgatgtcatacatcaggtcgcggatgccgtcaatgatgagcagccccacatcgggcatgttctccagcatatactcgataatccgcttccgcatgtcaggagtctgttcccgaagtacgatgaaaacaaagtcgtccctgtcttggtcggtcggcagcccggcaagccgcaggatgcgttccatcaccttgtggcaatggtatctgctctgttcggtgtccacataaaggattttccgtttgtccggaggcaggcacgccgaatagtgcagcacctcgtcattggtcagtgccgctgcaacgatggcggagatgttgaacgtcttcttgcttttcgccttgcctgtggaggcgctgaagttgcccagcgtcccgatggtggagccgttcacccaaaggatttcaggcggcacatcgtaagtgtccgtcactttcaggcggatgcttttccaaagggcagcaaaatcttccttattcatgatggtgtcccctttagcctccgtgcttttcttgttttccatgggctttacttctttaagggatggttgagaacatacttctgcgcttcttgctctatctgcgttttggtctttaccggattctggcggagccatgcttccagttcggacttctcaaaataaagcatcttcccctgcggcttgtaatggggaatcagattgcccgaagtcagcttgtaaaggtaacttttggacaggttgaggaatgtgctcgcttcatcaaagctaagcacgttcttggttaggaacaacattctttcgagttcttccactcgcatttccaaagttttttccatattgcttgaaactttttggtgaaacaatatgaaggtgcgcaccctcgttttatttttgatggggcaaaaatcggcatcctccaaaacatcaacacataagttacgggtaactcacgtgaaatatttttgttttgacctatgccgacatgccgcatcgttttgttaacgggggcaaagttaaaggcttggaaatgaagtctaattgagctttgtttgaccgctcagactatgctcaacctttttgcagttgcttgatgtatttgtctatgatttcgtatcctttcgggtagatgcacttcacgttgtctgtcgcgctcgacaagtcgctgcgtgtgaggtatttgtcttttatcttggcaagtaccagcttgttgttggctatgacggactgccactcataagcgatatagttgtagcagctaagctgcatcatcagataagccagcaagcggttgttgttggacttcaataccccgttcagtttgcaggcgaagaagtccgaaaggattttcggggtgattgtcgtggtgaatatgtgcgcttcgttgatacattcgaccaacagtttgatttgttgcgttgtaaggactgatttgaatggattggatttcccgactatcttggtcggctcaggctgtgccttctcttcttcttttggctgttcttctgatttctcatccaaaggaacagaggcatgactggcgtcctccgattgttggaggtattccagatattgggtctgcatgacaaggcgcacaatggaagaaaagaacggaagctgctcatcatagcaagtggaagattgcaggtatttgtccatatcaaaagaagaacattggaacgaaatatattttttccgctcgtcaaaagagagattctcgaagaaaccgctttcccaaaggaagtccggcatcagtatgtcaaaacgtatattgtgcagggcacggttcttttggcatagggatacaaggttctcggtcacgttgaaaatttcttgccggatgtagtcattcatttgcgcttccgtcaggtattcacgctttaaggcaagcgcattagttttcatcccgtattcatgggcaacacatttatcaagtaactgctgtatctttttgaagttggtttctctgaaatcttccatatacgttgtgcattaaaatcggtttgggttacaaagataagtgatggataccgttttcaaagcaaacaaaagcaggagaaaggaagaaatatgcagcatctttgttaataaagcataaatataaggttgctaaaacggcgaaagtactctttctttttcttttcgtcaggaagtacacttttagtacgcccgataaaaagaaaaatccctgataatctttcgactatcagggatttgaggtacccagacccggggtcgaaccgggatggatgttactccactggtgtttgagaccagcgcgtctaccgattccgccatctgggcaactatcatcagggaaacgctttcccttaattgcggtgcaaagataggaacatctttctaatcctccaaatatttcccttgttttttcgctttacgctcaataatccacctatcttgcaccgacaatgtacggttttatgatcgctgacacgtagctttcaaacttctgcgcagggcataacgcgtacagatatacgaacagatagagcctgcgaaaaagatgattccggtagaaaccatgatattgccgaggccgaccagcggcgaaacaatacctccaaaggcaaatcccagtgctcccagcagtgccgaagcggttccggcattatcgtgttcgcaatccatagccagcgtattggaagctgtaaaagtaagtcccagcatcgacaaaagaccaatcagcagcacttcatatatccagaagctacagccagagaccaaagctatcagaagcaatgcagagaaaataaccatccctgtactgccataatgcaacgcctgctccatccggcggaacctgatatccgaagctgccgatatgacgatggaaatggcatttattccaaagcatatactaaacatcagcggagagaatccgtaatgctgctgcatgataaacggcgccgatgagatattggcaaacaatactccctgtgcaaaaccaaactgcaacgtatagcatacataacgatgattacggagcacttctgcaaaactgagaaatacgttcttccagcttttctgctttctggcctcaaccggcagtgactcttcgaaatggatacttccccaaagcaatatcagtcccagaacaaaaagacaccagaagatgccgatccagccaacactcccggccagaaaacctcctcccataggagccgctacgggagcaacgccgttgatggcacctatcagcgccagcatctttgccagctcacgaccggcatacttgtcggctgcaaccgaacgtgaaatgacaattcctcctgctccggcaatgccttgtaccaaacgccagcctacaaactgcatgatggtatgagaatatatacatccgatagtagcaacagcgaacaatgccattgatatgatgagcggcaagcggcgaccgtatttatcacttaacggtccgaaaagcagttgcccggcagcaagcccgatcatacttgccgtaagtcctaactgaaccatggaagaagtggtatggaaatagtccgacatagccggcaaagtcgacaggtacatatctgtcacaaacggaccaaacgccgtaagcatacctaaaaataccagtataaatacttttgaattctttttacctttcattttgctatccttttttgtcggtgcaaaattacggaacttctcaagatgtatagcgacgttttaccgcacaaaacatatcattttaggaacaaaataaaattatttgccaacaaatctctacctttgtccatatacaacagcatactaccatgaagataccctttccatccgatacgacaatcatgcaatacgcagaaagcgaccttgcctcgctgacgcattatcctttccggtttgcctgcggcatacagctgctttgtgtcagtggaagaagcattatctctaccggagtcgagcgatatgacttctgtgaaacttcagaattgatttttctggcgggaagtctgatacaggttatcaatccttcaccggatttcaaggtgagaatgctgctgttccccaaggaaatttttctaaaggcttccttgcctatcgatacgtcttatttcaattacatcaccgaggttccctatttcaaccatgcggcaaacgatgcaaatctggcaagctggagaagagtgaatcaatggatggacatggccgaactcttgtttacgcatccggcaaagcattttcgcgagcaactggaacaaaactttctgcaaagtttgtttatgtgggtattcaacagcattccgcaaaagtatctttccatacacaacaagtacagccggaaacaaatgttgtatcgccgctttatgttcttgatacgtgaacacagtacgcaagagcatcagatcggttactatgccaaccaattgtgtgtcactccacgctatctgaacgaagccgttattttatactcgaacggacgtactcccaaacaattgatagacgaacagctcacggcagagttaaaagtgcaattgagcaatcccagtctgtctgttacggaaatagctcagttgcttaattttcaggagcctgccaacatgagccgtttcttcaagaaaaatacgggtatgtctcccaaagaatttcgcagcctgaacaagctgtaacagcatcagccgcgctttctattgataatatcggaaggcaaatgaatcatgacataccgtatatggtagaagagattcctttcgaatgttcgggaagacatggcgtaacgtgcacaaagataggcacagacagctccggcaaggaacagcaatccggcagtaaacctcatatcgcctaagccgaccaacggaggaaccactcctccaaacaggaaaccaatggctcccagcaaggcagaggcaatgccggcgtacctacgctcacaatccatcgccagcgcattggaggctgtatagctcatgccaaccattgcaagcaaacagaaaatcagtatttcatatatccagaaattacaattcaaggaaagagcaatcgtcaggcaggcagaaaagagcaacattcccttgctcccgatatgcaaggcatgtcccatagtcgggagcttgactgatatggtagacgaaataaccatggcaatggcgttggctccaaagcatagactgaacatcattggagataatccgtagtgctgctgcatgataaagggtgcggaagcgatgttgacgaacaacactcccatcgtaaatccgtattgcaaaatatagaacaaatactgacggttgctcaacacaattccaaagttccggcaaagccctttccaatttacatcgagccgacgctctgcgggcaatgattcatttaaacgaaaaacaccacccagcaacaagatacccagcagaaacaggaaccagaatataccgtgccaccctgcctcttctgccaagatacctccacctatcggagctgctaccgtagctatcccgttgattgctccgataatagccagcatggtagccagttcatgggcagaatatttgtcggtagctatcgaacgagagagcacaactccccccgatccggcaatgccctgcacgaagcgtaagccaacaaactgcatgatagtctgtgaaaagatacatcctacggttgacagcaggaataaagcaatcgcaatcatcaacggacgacgacgcccatacttatcgctcaacggtccgaaaaccagttgtccgacagccagtcccaccatgctggatgtaagtcccagctggaccatagaagaagtggtatgaaaataatcggacatggcaggcaaagtaggcagatacatatccataacgaaaggaccaaatgcactcaacatgcctaaaaagaccagtataaataattttgaattttgcttctttgttgtcattttctcttgttcatctctatcttcgcgtgcaaaattacgccattcctgtaaaagaatttatttctttaaaagtacaaaacatttcattttcagaataacggcacgatattatggagaatattgatacatttgcagtataaagcagaagagattcatgttacatgcattaccatcaatcacgcagcacatcctgtgcgaggaaacagacctggcccagctcaagcagaaaccgctccactttaaatgtggaatttatttaatctgtacgcatgggcaggcattgatatcaacgggtgtacagcaatatgtattcgaagaacagacagaactcatttttttgacaggcagtctgatacaagtcgttcagtcttcgtacgactttaaggcacgtatccttatgtttccgcaagaaatcttcctgaaagcagtactccctattgatactccttattataattatgcgcatgaacatccctgctatcatcatacggaagacgagcgaagccaaaagacctggaaagaaatcaacctatggatggacatggcagaaatgcaattcatggacaatacccctcagttccggcagcagcaggaatacaactttctgcaaaatctgctgatgtggctgttcaatacgattcaggaaaaacaagaaacaaagaaacagtatagccggaaacagattctttactaccagtttttgaaactggtaagagaatatagcacaagggagcatcaagtggccttctatgccgacaaattatgtatcacgtcgcgttacctgaatgaaatcatctctctatatgtaaacggacgcactcccaagcaactgatagacgaacagttgacagccgagatcaaggttctgctggacgaccctcatctgtcggttaccgaaatagcccagcacttcaattttcccgaccagtcatacctgagccgtttctttaaaaagaacacagggctgtcgcccaaagagttccggaatcagaaaagatgacaacaaacaaaaaaataaaagggaacacatcacttcctaaagaaagaaatctgttcccaatttattttttcctattctactgaatagagaaatttgtatataagccaaagctatgagctggtatttccaaatgagtagctgtaatattttccggcactccttcattacagaaattataccattctcccgttacagggaatacatgctgcatatcaacaggtcggtcagtaaaatttcctacaacaacaagttgtttgccatcgacagtctccaaacgaatatagcgtccgtcgttccagtcattatcagaaaccctccactccttaaaagcattctgaccaaagacctccggataagccttgcgcaaagccagcagccgactataagtagtatataattcatttctttcgggtatatcctgataggaccataaaattggtttcggatctgttttatggtcttcaccggaaataatctccccttgttgattggcatctctcgaaacatcatatcccagttctccaaattgccagatcattttcgggcccgatactgtaaagaagaaagcagcattcgcctccaattgctgcatccgtacagccaaatctgtttgcaataatccatttccccatcgggtttgtttataagcgcaccgttcttcgtcatgactttccatataacctacccatcctccttccttcatcgttgtatgcaatgtagtcaatcctgtaaaactgcttccgtcactccagcccattgccgactgacaataagcgttattcatgttacgccatagctttataccaatttgagaaagctcactctcctcctcaatacctgtcagatgttcacaaatcataacagcattcgggtttgcttctttaacagcctgatagtaatcttttaaaatagccacacggctgccatcgtaatttcctgaagtgttttcgttactcgttttattcgtaaatccttttgtcaggtcaaaacgaaatccatctattttatactcgtcaagcaagaatttaagattacgctttacaaaacgacgtgtcagttcggattcatggttaaaatcgtagaaaacgctgaatggatgaggagctgtttcgttaaaccacggactgtttgaggcaggacatgcttttgattcattccagtatagccgtacattaggcatatttcctgtagcatgattatacacgacatcaaacaaaacagctattcccctactgtggcactcatcgataaaacgcttatacatgtcctttgttccgtaagctttatccaacgcaaagaaaaagcaaggattgtatccccaactattattcccgtcaaactcttgtaccggcatcagttcaacagcattaatacccagtgtctgcaagtaatccaacttttgtaaagccccattcaaatcaccactttccgtaaaatcgcgtaacagcatttcataaatcatcagattatcaacatcttttattttgaaattcgtgttattccaactatactcctgctgttgcaatctaaaagtagatacaatacctatacctttatctggatattgtctttcgtcgaccggatatgtagacgctgcaatatatttgtcattatcaggatctaaaattttttctgtataaggatctgccagacgcatggcccccttggatgaactccctacataatactgaaaacaatattccttaacaggatccaacccagaaacagtcatccaccagcatccctctgcttcatcacggtacatctgcgatgtttcatcattagccaatgtccagtcattgaaatctcccatgacatacgcataatctttgtggcttccatctgtcgctttatcataaagcacaaatgtcaccgattgattatcagtatccaagttaatgccttcctgaactccggccggcaatgatttttccttcacttttccgggaatgaagctgtgatattttgtatcgataacacttacaaactggtctttgttaagacctttcttgcgaccatctgcactacgtatgataacgcctaactgttcaacaggcgttgtgtcagaaccaaaccattcccgcacagagggagaaagtgttattgtccatacattagcttctgtctgacttttggtaaacttacatttttcaatattttcattccattcggcaggaacatacatccatactccctccctgaccactccggtatgaagatatacctcacccgcatatccgtataggtctgaggtcgatgatgctttaaatgtaatcgtgagaggctgatcggcatcgggagtttctggcaaaaaagtaaatccctcttttgaatcacccgtcgtttcaccaagtaaagtatccggtttagtgtcactgcatgaggtaataaaatttaatgccaacaagatataagtcagtatacgatttttcatagataaaagaaaaaaagtgcgtacaatgtggcataataccccatcgacgcacttttaaaattaatattgttatttagcaatcaattcataagtgtaatcgggagttgaaagatctacaataatctgataatctccagcagttacgctgatgtttccccctttaggagccagtttcccgtcgctatctccaagaccgaaatctccattaggaacatcccattcatcatttgcacggaatttaattgtaccatccgtcaatgtcatatccactttcagcttcaagtcggccggatcataaaccaaattcgtatcttcattccagccaccaggagttgcatctccaataactccaaagtttacaagctgagccgcatatgtaagttccttaatattgaacgtaagataataatatccttcttcggcagtcagattaccagcattttcaatagtcgacaatgttccttctgttgaaccagctccataattagggccatcccaattttgctgtgagatacatttgtactcaccattcaaataagcatatccggcataattaccttctgcatctaccggataaagtttccctataaccgcagcatctggtgcccacccctgatgagctcccacaacatacaattgctccggtccatcaatcggagctgcaggttccggttcatatggaataattcgccaattctcattatctttacaacttacaagcccgaaagaaagcagtaaggctaatgctatatacttgaaatatgttttcatatgtttctaatattacaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgatattatataagtttttttattttgaatatcccggattttgtgtcagattctggttgacagcaagagtatttgcatgaatcgggaatacctgcaaataaggttctgttttaggacgatcggttatggcatcgttaaatttaccaaaacgaatcaaatcttgacgtctccatccttcccatgccaattccagcatacgttctttcaacaaattatccaaagttgcatctgcatgaggtgcgccgacacgatttctgacttcatccaaatcggcctgtccactctgtccgttacgaaccaaagcttcggcacgcatcaacaaaacatcagcataacggaacaacacccagtcgttatgaggacactgaccatcttcggttgcagtcggatcatccgcatacttatacatacgtgcccccgccatcttcatactggtatcgctcttatcaaactgaagtttaattgccatcggtaaatattccaaaggttttcctgtctcactgttgataacttcctgcccgtttacgacaacccgtcctgtataataggtcagctccaagcgaggatcaggatttgccgtaccatatccgaatgttttcatagcctcaatagtagcagaagatccgttccagcctccattaccaaagcctaatgcctttcctacatcgtaatgacgtgaacgtaccagatacatattacgagctttatacaatgttggatccataggaataacaaaaatattttctttagaaccttcattgtttacaacgaaatttgcaaggaaaccattcgtcccctgattcagtgcatacccacattccttgattttatcacaataggcaacagtagcctcccaacagtttttttctgttccatctaccgtaaacataatattcttgccatcaggacgagattggtctgtccagtcattatcggtataaacttctgcattcagggcaagcttagccataaggaaataagcagcagccttagtcatacgtccataatattctccttggtctgcactcttttcatctacaagtaaaggaattgattcttccagttccttctttacaaaattaaatacctcactacgttcagactgcttgacatccttcatctgagttaatgaagattcaacaatcggtacacgtgcaaacatatccagcaaataataataatacatagcacgaatggcacgtacttcggctttatagatatcgaaatattcattgtccggatccatttccttcaattcagtcaatttatcaatagactgattacactgaactacgactccatacaaataatcccatgttgaaataataaggccattattcaccccccagttatgggtaaacaaatctctccatagtccaccgtcatcccagtcaccacctcttgtcggaaggatagcatcatcagcacaaaatgtattcaagtcataaagtcctctgtctgttccagccaaaccactacctcctgcatctgctccaatcttcgtataaaggttagcaactgtatttaaataaatcatttccggatttttataagcttcactttccggcatctggtcaacaggattttcttccaaaaaagaagaacatccactaaaactcattgctgctacaataaaaaagctatataataattttcttttcatagtaatattcatttaaaagttaaggctaagtcccagtgaataagtacgtgtaagcggatagaaacgtttatcatcaacacctaaatcacttcctactgtagaactgttaatcatcggtgacaatcctgaatagttagtaatagtggctaaattatttacagagaatgtcaatcttaaagaattgatattcttcaagttctttgtattcaaattccaacctaatgttacataatcaatatgtacataatctcctctttccaaccaataatcagttacagtctgatcgtggatattcttttccggagctcccttcattacgttgtaagtagggaataaactcatattcatgtatgacaaagaagttccattataaatcttatgcccaaacgcaccactgaactgagtctggatatcaaactgtttgtaacggaaactaatattaccacccaaatagaacttcggcatagcttgtcccgctatataacggtcctttccatcagaaagatcaataccttcttgaccatcaatgtcaagaatatgataagtatactcaccattaccattcatatcaataagtccatcacatttaggtaaatagaatacgcccaatggttgtcctaccatctgataaataacttgattatttcctccaataaatccagcaccattcattccacctaaattcatatattccttcgcgctcaatgattgtcccatatatgagccactcaatgacaacaatttattcttctgccaagagaagtttgcagaaatggtcaattccatatctttggtttttacaggtacacctgttactgcaacttcaataccggtattttccatttcacctaaattggccaacaaagaattgaatgcaaaaggaggtacaggtacagcatagttatacaacaagtcacttgtctttgaataataataatctaaagtaccagtcaaacggttatcaaagaatccagcatcgataccaatatcaaacatacgttttacttcccatttcaggtcagggttatcattacgattaattccgtatgcaacaaccggtttaccatttacggtagttactcctgtcggactcatcaatttcaaagaattatacgcgctaattgcatcctgattaccagtaagaccgtaaccagttctaatcttcaaattggaaacaacatctacatccttcaagaaactttcttctttcaatacccaagccaatgaagcagatggaaagaatccccacttattatttgctcccagcttagaagaaccatcggcacgcatatttattgttgcaatgtatttatcagcaaaactataattgaaacgtcccatgaatgaagcaattgaatagccattcgaatatgaactgacatccccatatttcacttcaccaccagcacctaaattattatattcaaagaagtttgtaccgaactgttttgcttttgcgccaaaacctgtatatttataatcttgcaattcagccagacctaagatatcaatataatgctttccaaatgctttcttataatttgccgtaaagttacccaacagcactccactcttattatccgatttttcagcaataccactttgaccttgtcctgccttaatattgctcggagtatattttgaattctctttcacattataagtataagaaccaaaagcactcaatttcaatccatctataacagtccatgtaatacgtgcattagcattaatgtaactattcgactcaacatcttttatagttaaacgtcccagagggttttgagtttcatttgcatttgggtcttcaggccatgaaccatcagcatttgcaaaatcggggaaagtcgggttaaatgcagctgcagaatagaatgtcttctgatagtcattcagataacgtttatcaactttagaaccaaacattccgaaatcgagtttaaccttatcattaaacattgtttgcgaagcatcaagttttgctgtataattacgcatataattatccttaatgatacccttctggtctataacaccaatagaagcacgataattagaggattcagtacctccaccaaaagacaaacgatgattctgagtataacctgtctgctgcatagcttctataaagtttgtattatatcccatatccaatgcattagcatagcctctatcggccacaacctgacgatatgcattggcatccagcatttccaaattcttataaactgtttctataccaaagctaccatcataacttaaagtcttaacgccatttttacctttaatggtagtaacaacgataacaccactcgcacctcttgaaccatactgtgctgtttctgaagcatcctttaaaacggtaaagctttcaatatcagctggagagatagcattcaacatactcaaatctccaaagacaccatcaataataactaacggatcattaccacccgacaaggaagttgtaccacgtacacggatagaagctgaagctgtaggatcaccacccgatttctggatatttacacctgcaactttacctttaatagcttgcaaggggttagttacaacgccagcattcatatcttcacgtccgacacgctgaattgcacctgaaacagtacgctgactacctgtagcataaccgataacaataacatcatccaaaacttctgtatcctcatgaagaacaactttcatattggctgttgccggaagttcctgattcttataaccaataaaggaaacgaccaaaatatcgcctttattagcatccagagtaaaatttccatcaaagtcggtaatggagccattcgtagtaccttttactaaaatattggccccaataatagcctcaccatttttgtctacaacacttcccttgacaaccaagctttgcgctaatacttgaagggagaaaaacatacccactattaccaacagtagatatttccatgtgtgtttaataaatagattctttttcatattattaaattttaagttaataaaatttcatatagtctacactccattatggattatacaaatggagccaatgtattatatatacctattgaaagaagatttactatctaaaaaagacaaactttgtaatatatcagaaaaaggaatactccctcttctgatatattattaaattcaatgcctatttacttgatttctttgattgaaatagcgtaaccgcctccaatacctgctttcagagttattttactcttgctcgttacttttttctttgtaatagtatatgcctgaggatttttatcccaacttgcatctttagcgtcggcataaatagttgcttcatatttcttgtcaggatcgaggaagtcgaatgacaatttagaaacgtgaccattataacctgccgtacatcccacataccagtcgtttgtattctttgcacgacgagcgatggttatgtattctcccggttctgcttccaagtacttagactcatcccagtcgacagccacatctttgataaactggaaagcatccatgaaacgttcatagttttcaggaacatcagcagccatttgcaacgggctatacatggttacatacaatgccagctgacgcgcaagtgttgtacgagcatgagatttattattcggattcatcttactgcaatccggttcaaagatacccggagtataatccatcggaccaccgataagacgggtaaacggcaaaatcgttgtgtggttcacattgttaccaccaaatgattcatattcagtaccacgagccgattcgttaccaatcagattcggataagtgcggcaaagtcctgtaggacgtacagcttcgtgagcattgaccataatcttgtaatcagcagctttctttacggcatacagataatgatcgaccatccactgtccgtaatgatgttctccacgaggaatgatatcacctacatatccactcttcactgcatggtaaccattatccaccataaactggtaagccttatccatgtggcgttcataattgcgtacagaagcagaggtttcatgatgcataatcatttccacacccttgcttgcagcataacgatgcacctcttctacatcaaaatcaggatacggagtcacaaagtcgaacacataatccttgctcttgccaaaccagtcttcccatccctggttccagccttccaccaatacagcatcaaaaccatttgcagcagcaaagtcgatataacgctttacattagcagtattggcagaatgttttccattcggttttgtttttgagtaatctgtttcacccagttttacacttgagagctcatctgtataggcccatgtacctttattggtaatcatatcccaccaaattccgatatattttaccggatgaatccatgaagtatcttctatcttacaaggttcattcaggtttagtgtaattcgagaagccagaatgttacgagcatcatcgcttacgataattgtacgccaaggcgaagtacacggagtctgcatataacccttatctccttttgcatcaggagtcagccatgattcaaaaatcagattcttgtcatccaggttcaagctcatgcaagaataatctttcaaggcagcttcatgcaagttaatataaagtccgtcatcagtcttcatcatcaaggcagtctgaacgccagtctgcgagaatacatattgtgatgaattttcagtgacagccgaactcatttttccacgaatttcagacaagcgggaagtagtataatcgtattcctgcgtatcgtaatctcccggaatccagaaagccgtatggtcacccgtcatagcaaattgggtatgctcttcctttatcacaaaataattcagatttttctgctgagggaactcataacgaaaacctaagccatcattgaacaaacggaaacgaatgacgatataacggtcattttccggctggtcaagggtaacttccagttcattgtagtgattacgtatttcactttcttctccccacaccggatgccacacttcatcgaaagtagaagtacgagtatctttaatcttaaatccggtcatcagattcgtcttctcgtctactcgttctttatcttttcgttccgtccattcgaatccgattcttttttcaggatcctctcttttcaattccaggccaagagtgctgggcttaataacagctttgtccttaaagaagagctcgtatacaggagccccgttactgttcaaactaaagttcatcttcaaattaccgtcaggcgacgtcagattttgcgcattcatcgcaaacgcacagtagcacatggctacaaaggcaaaggttctttttagattcatagttttaaggcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttttctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgttaaggtttaaataattaataagtttttagctcaaaaacaaaattagacatcccatcatacatttattttcttcatacaaaaaatagaaatgcataaaaatattaatattttatttatcaggtatttagcatataacaggaaacctaaaaatagaaactttttagaaacaaaatatcaagatttcacgttccttcagagataatttatcagcaaaactgaccttccttccgctcaggaaatccgtagcttccggttgtggcaatatctcccgataaggttcaagactcagttcctgcggagcatccgttccattcatcacgacaacaaccgacttaccattgtatgcacgctgatagacataagttccctgactgatggaataatgttttaatgtaccatgagtaagcacttcattccccttgcgccagttcaataacttacgggtaaaatcgaaagcctcattctgtaaggtagtacgcccttcaggaacaaagcaattcactttatctcctcgccatcctccgggaaaatctttccgcaactctccgtcaccatttcctttatcacccgtcatcaagatttcagttccataatatatctgcggtatgccacgcgtagtcaacaaaaaagtcatagcttgtttatagcgtgtcaggttacgagccttctcatcagttgtagcaaaacgagaggtatcatggttatcgaaaaataccagcaggttcatcggatcggcatatacgatatcctgtgtcagatagtcgtacaacttatacagtcctcctccccattctccagtttcttcatcgaaggcctgattcatcagactttgcaacgggaaatccattacagtcggtaaattcgaatttcgtggagcagccagcttgctgtctttctgccagtacgaaaccagcacattactattcagccatgtttcacctacgatattgaaataaggatattcttcgagtacctccttacaccattcactcataaaatcaaaatcagcatacggatgtgtatcctgacgaataccgttgatacctgcatattcaatccaccagatgctattctgaatcagatagcgtgccacatgccggttacgctgattccagtcgggcattaccgacgtaaaccatccgtccgtcgcaatcttgcgctcatactcactggcatgtacatccatcacactggcagttttgaacgaagtctgcacatattccgaatgaaagttaaaccactccttagaaggcttgtccttgaacagatagttctcgctaccgcaatgattgaaaatcatgtccatcaccaccttcaatcccttttggtgcgccttgtctaccagtgtcttaaattcctcattgcttcccaaacggcggtctatctgataataatccgtaatggcataaccatgatacgatccgtccttcatgtcattttcctgagtaggattcagccagatcgctgttactcccaggtctgcaatataatccagatggtcggaaataccctgcaagtcgcctccgtggcgagcaaacgaatcattacggtccaccctattttccagcatcccttctacgatatcattatccggattcccattggcaaagcggtcgggcataatcaagtaaagaacatcttccgaagtaaatccctttatatcttctcccttatgtgaacgttccttgagttcataaggaatcgtcagtgtttttttcccttccttcaacaatatattaaaagtctgtgcttttgcttccgacaaatccagataaagcaacaagtaattgggattatcctgctttaccacctccttcaggataattccttttccagacagtgtaacattggaagaagcgatgtgatcgccatacaacaaaatctgcaattcgggattttgcataccagcccaccaaaaactaggagcaaccttatgaactttgatagctccagccgcacgacaaatgccgaaaaggctaaagatcgccataaataaaagccatgtatgtttcatgatatttaagattaatatgatttaaaatgtttttcgttgcaaaaatataccattgctgattttttttgttatatttggaaattaaatataaacttattaaaaacataagaaccagtaaataaacatgttaacttaaatctagcatatcaataatataaatggttttaactcctaatccgctatattatttgtatgttgaagcatataaatgaccatcatggaacaaaatatatttactactggaataaaacatcactttttctggctactggctggcatgattctattcacattatccgtcaaagcggaacaaccttcacacgaaaaggtattagagcagcttgatcaggtcattacccaaaaagctttataccgggcagaacgggaacggacactgcttcaattgaagcagcaacttcactatgccacgacagagaaagaaaagtacaatctttccaatgaactgttcaatttgtatctacattatcaggccgattctgccttgcactacataaacaaaaaagcagaatatgccttaccgctgaacaagcccgaactaaacaacgaaatcattatcaaccgtgcagaggttatgggagtaatgggaatgtacagcgaagcactggacgaattacaacagatacgccctgcattactgagcaaaaagaatctgatctattattattttaccctgcgtacctgctacggatggctggcagactataccgtaggacgtgaagccaagcaaaaatatctgcaacagacagacctgtatcgcgattcaatcatgaacaacatcgattcgtgtgtagaccgtaacattgttcaggccgaacgatacatcttgtcttctcagcccgacaaagccattcccatgctcaaccagatgctcactacttcactcgatatgaagcagaaagcttacgtaaactataccctatccttagcctacgaagcgaaaaatgaaactgacatgcagatttactatctggcacagaccgccatcatcgatttaagcatgccggtaagagaatatgcctctcttcagaaactggcacgaattatctatcggcacggagatttaaaaagagcatacagttatttaagctgttcgatggaagacgctgtagcatgcaacgcccgtctgcgttttgccgaagtcacagagttttatccgattatcgaccacgcttattcacaaaaggaagcgcaggaaaaaagaatggtcgtcatcctgttggtaggtatgggcgtactggctattttgctgattatacttgccctgtatttgtactatggattaaagaaactgtcggtcatgcgaaaaaacctgtatttatccaacaaagagctacaggccgccaacatgaatctggctcagaccggcaaaataaaagaggtatatattgcccgctatctggaccgctgcgtcagttatctggacaaacttgaacaataccgccgttcactcgaaaagcttgcaatggcatcacgtatcgacgatctgttcaaagccatacgttccgaacaattcctgcgcgatgaacgaaaaaatttctataatgaattcgataagtcgttcttggagctgtttcctaatttcattgccgacttcaacaacctgctgaccgatgaagggaaaatatatcccaaacccggcgaaatactcaatacggaactccgaatctttgcactgatacgtctgggagtaaccgatgccaaccgcatagctcattttctaggctactcactggcaacggtttacaactaccgaagcaaaatacgtaacagggccaaagggaacaaagacaactttgaacagacagtcatggagctataatccatgacctgccaaccggaatactctctcctacgtatccgagagtaacacatatcttaaaagctcacgccggctacaaagtaaaatccttccgtggagggattgcatatagccttggcaaaaagcggcaacgaccaatgttttgtaatctttatttctttggaagcttttacacttacctcacacacggcaaacccattgatcatttccttggaatagctggagttttctcctcctgtatagaagtcattttcccagggagtagcacctgcctctacactccagtccagtcctcccaatgtgaaaggaacagaaacggagaaataggaagcataagctctattgccatcgactttatagccaacatatccggcaaagttcgtaaaccagttcacagccaataccccgaaatcgtagcctacctgagcctcaaatgtatggctggtattgtgcgctccataatgaaaatatcccggttcgccactgacccagtagtccgtcaccgaaacactgaagcccttcgcctcgtatcctaacgtcaaatcaaactcttttgtatcattcttgtcgaatccaaccgttccccatcccgtcaaagacaggcctttataagacagagacacttcaggctgaacgctgatacctcctaaatcctgcccacgccagacataaccgctcaccagatctataccgacacccgcctcaactttatcttgcgctttcacctcgacggaacaccagaccaacgctacaagcaaccacactatacggtttcggaatacttttatcttcttcatttgcatatatcaacaactattaaacaaaacgggcgcaaagttagaaaataaaattgtttcaaagggcttttaattcactatcatttatcggaacaaggtacaaagtactataccgcagaaagaagcagctcttttatccccataaagatacacttatgagaatcaactatttttatcagactttacggtacagcgatgaataatgtccataaattcctgtcctgtaatcgtttccttttccatcaagaaagcagccgcctcatgcataatccccatattttcggaaataatctttctcgccttgtcgtgagcttcctttatcatacggagtacttcctggtcaatatctgccgccgtatccgtcgaacaagtaagcgacgtatcacctcccagataagcattattcaccgtttccagtcccatcatatcatatttgccgctcatgccataccgggtgaccattgcccgtgccagccgggtagcctgttcaatatcgttcgaagctccggtagtaaccgtattgcacacaatctcttcggcagcacgtcctcccgtaagtgtggcaatccggttaaacagatcctctttactctgcaagacctgctctccgctatccacctgcatggtatatcctaaagctcccgaagtacgtggaataatcgtaatcttatgaacaggagcagagtggctctgcatggcagctaccagcgcatggcctatctcatgataagccactatttttttctcgtcggccgataaaactttccccttcctctgtgctccggctattaccgtttccacgctttcttccaaatcagaagttgtgacaagcgtccgccccatacgtacggcacgcaaggcagcttcattgacgatattcgccaattcagcaccagaagaacctgcggtagcccgtgcaacaatatccagatcgattgaatcatgtttaaccttcttcaaatgtacattgagaatagccttccggccctccagatcgggcaggtccatctgaatacggcggtcaaaacgtcccggacgaagcaaggctttatccaagctttcaggacgattggtcgctgcaagaatgacaacccctttccggccatcgaaaccatccatttcggtcaaaagctgatttaaagtctgttcccgttcatcgttacctgcaaaggcaccatccctctttttacctatcgcatctatttcatcaataaaaataatgcaaggcgctttctcagttgcctgtttaaacaaatctcttaccttagcagctcccattccgacaaacatctgtacgaactccgagcccgatatagcaaaaaacgggaccttggcctctcctgccaccgcacgggctatcaacgtctttcccgttcccggagggcccaccagcaaagcacctttaggcagagaagcacctatttcggtatatttctttggattatgtaagaagtccacaatttccttcaaggtatccttagcctcttcctgacctgctacatcggcaaatgttgtcttgatatcagcatccgcataaatcttcgctccactgttgccaaaagacataaagtttcctccagcccccatacgagattgaatagtcttacgggtctgatgccaaataatatagaaaatcaatcccggcaaaatccacatcagcaaaaaattcagaataggcgaattctcttctggaataatctgattaaacgcaatctttccgtcggggttaggactatccgcctttaacaatctgtctaccaattgagggtcatttacttcaccggtctggaaagttttcgtttttccaccgttttcctgagctgtaaagaaaatctgattactcttaatcataacttcctttacgattccactgtctactttttcgataaatgtcccataatcggtagatatgatctgctgtccggtgagttttggaaaaaccagtccgttcagaattaacacgatcaatattactcctaagaatcccatatagggatttcccttctttactggttgattctgcacatcttgtttcataattagttcatctttaacctttacaatgcaaatatcgacaaacccgatttaccgatggtcatccaaaaagcataaaaaatgtgcagaatctcttattccatcactttttctttttcccgattctgatagatggtctttatcaggctgcaagccatcggcaaatcaatgcttccggtattgatcatcaggttataatgatgaggttctccccatttttctcccgtgtaatattcataatgagcgatacggttgtgatttatccgcttgatctccgcctcagccttatctgccgcaatgccatattcctgcacgcagcgcgcacaagcatttttcaagtcggaataacagaaaacctttatcaggttcggatagtctttcagcacaaaatcggcacatcggcctacaatgatacaagaccccttttctgccagttcttcgatgatcttactttctgccacaaacagcacatcatccgacgagaggctacgctccagcgactgttcactgctcttgcccaagatacacttcagccagaaagaaggaatagactgctcgtttttcttgatatactgctcgttgatgccactcttctgggctaccagatggataaactctttggacaacatttcacccaacagatgtccaccgcttccatattctctcgcaatggtaatgatgacatgctgagcatttttcagtgccaccgtaaccttgtcggctccttcgttaatccatttatcgaaacagcggtaatacgggctgatgaaatgtacaatcggacctaccagcaacgcagcagccaccgttccttcacgtaccccgtagatgcccgacaggaaacacaaagacagcacgcaggcgatacaaaccagcgaaatatcgaaacacaactttacgtaaccaaattcaccatgaaagcgcttggagataacccggacgaaatattcacccgccatcatcgcaacattggctttcacttccagagttataccggcagccaagactacacatcctaccagcagataggctatctgactggcatacttcaccggctctacccaatacagtatgttcatgcacacatcgataaacgttccgaaacacaaggaaatcggtatctgaagcaagaacatccgcaagtcctctcttagttcttttctcgtcatgaaaggaagttcgagcagtataaacaacagattcagagcgattgtccattgccctatagtaagcggagtaaacatactcagcacataagtaacactcgtaataggtgaagttcccagcaatgctcttgttataagggcgatacccatggcattgacaaacaaggaaactgcaaacaagacgtaacgtctacacatgaatttattcataaagccttcaattaatcggcgcaaagttcatgttatttttttatttccattcataaaaaaataactgttcttggttaaaaacgaaacaaatcttatttttgtaaagaaaaaacctttttatgaaattatttgatcctgacaaaaacggttttcctgtttccggtgaagaaaatcccccttatcatgttgtaaaatgttctttcgagaaagaagaatccgtcgttttgaagaaaggattttttattattttagttgcaaacggaacagcgttgttatcgaacagcaacgacagtcacctgatccggaaagatgatctcattgtgctgactccaagtatgaccaacaccctgcacgagaaaagttccgattttgccatgacttgcatttatatctatcctgattatttcgatacgctctcggacggacaggccatgtaccatcaactggccagattcatcaacaaatataatatccccgccgttcatctggagccggaggtatgcgattacctgcaaaagactactgccttgtttacgaacaaactgaaatacttccggccctatcaaaacgggattatccgccatttgtgcaattttctgttgttacaaatagccgatgtcctctgccggaatactcaacatgcttcggtctgtatcaaacggacagatgagattttccgcaatttcaagaagctgctgataaacaattacaagaaacatcacgacatcctgttctacgcaggccggctgaacatatcgaccacctatctttcccgcattgtaaaacgtacaaccggacgcacggtccgctttcatgtatcggaactactctgcgcataagcgaaacgcttgctcgaaagcacggatatgggaataaaggagatagccgataacctcggcttttccgaccagtctgtcttcggcaaattcttcgtcaagatgacaggggtttctccgctcaagtacagaaaaagatgaaactgcaaagaagctactagaaaaagaaaagagccaagcatctgattactcattctgcttagctcttttcctagtacccagacccggggtcgaaccgggatggatgttactccactggtgtttgagaccagcgcgtctaccgattccgccatctgggcaattatcatcagggacatgtttccccttaattgcggtgcaaaggtaggcaaatattttaaaacaacaagcatttgtgataaaaaagtgaaaaaaaatttttatctaacactatttagaacgctttccaacctttgttcgaaaaataaaggttatcttagcataaacattaaaagttacgccgatatcatgaataataactactactgtatcatcatggccggaggaatgggacgccgcttctggccttacagtcgcaaggcattgcccaagcagtttctcgatttttttggcaccggacaaaccttactgcaacaaaccttcgacagatacaagaaaatagttcctccaagcaatatctatattacaacttataaagactataaacaaatcgttctcgacatgcttccggagataacggaaagccagctcattgtagaagaggaaaggcgcaacaccgcaccgtctatcgcttacgcgtcgcacgtcatccagaagataaatcctgatgcgaccatcgtagtggctccgtcggatcacctgattctgaaagcggacgagtttaaggaggctatcctgaagggactgaagttcgcttccgaaaacgacaagctcgtcacactgggcatcaagcccaaccgccccgaaacaggatacggatacatacagattgacgaggaaaagaaaggagacttctataaggtgaagacgttcatcgaaaagcctgcacgtgaattcgccgaaatattcgtgcagagcaatgagttttactggaactcgggtatctttgtatggcatgtaaatacgattctgaaagctttccatgaaatgatgtcggaaatctgtccgcgtgtggaatgcgatgtgcccgattttacttcgtgccccaatatctccattgattacagtatcatggaaaaggccgacaatgtatatgttcagttgtgcgacttcggatgggccgatctgggtacatgggatgcgctttacgatgcttcacccaaggatatgaaccgcaatgtgattatcaacagcaatacgttgctatacaactgtaagaacagcatcgtactggtacctgaaggacagcttgccgtcgtgcaggatctggacgggtatctggttgcgtcacgcgacaatgtcttgcttatctgcaagaaagacgaccaggattccatccggaaattcgtgaatgacgtagagatgaaattcgaagagaaatattcctgatcccagcaccgtacatacctttccatcaactctgcgtttgcttgcggtaatatgggaaaagagaataatgaggacttaaaaagtttttgtacaaagattttttgtttttgtacaaaaaataaaaaaacgtcccgacaaataaacaaaaacgtgcccacgtttcatttggaacgtgggcacgttttttaacaattgtccgcaggatgattccggaaccgcatcaatactcgaaggtaataccgatagtaggcagtaatgttccgctttcctgcttgatagacttcatgacatagcgttgttcagaaaggggtgccgacggattttctatctgtcccgtactcatcagtacatcaggctgacgaagcttgctcgccgtaatgttctggatatcgaggtaaattccgaacatacacttcttccagtagaacattttgtcgacacggatatccaactgaccgaatgcgggcagacgctccgtgttgtaacgaccataatcgtaataggcttttccctgtacattccacgcttctaccagcgacgacttctccacatcgtagggtgtatatggggaacctcctatgcaactgactttcattcctacactccactgcttagggaaattataggtaccgctcacgttgaagatgaaacggttgtcccatgccgacggaacataactgccttccttgccgttgcggaactcactcttgaaaagggtcaacgacgaagacaggttcagacgctgtaccagtagccacttgaacatcagttcgacgccatacgaacggccctcggctgtggataccagacgttcgttaccaatcacgccgtagtcatttcccttgcaggccaaggggatgccgtcggttaccgacagcggcatatcgtgatagaacttatagaacccttcggccgacagttccatgttttcattcggctgccatgtcagtccgacactctcctgcgatacggagatataatccaggttacggttcaagtacgtcccgtcgtttcccttgaatcccagtgccgtataaggcggaagctggtaatacaagcccatgtgtccgctcagaaacaagttatcaatcaggcggaaagacaccgacaggcgcggagaaagctgtcgccagagttccttcatcttatcattgtaattgtttccgtcggtacgtacgccgagcgatgccgtgaaacgttcgtcgggtgccgtatagtccatcgaagcaaagagtccccagcggaacagatccaaggccgtacgatagtcgaatacctgtgcctcatcggtaaagactcgctgataagtcgtattggagtattgtgaataattcaactcgatgccggcattcagtttccatacgttccatgtagacgtattttccatacgcagttttgtctcctgttctaccgaacgcaggcggagggtcaggttatcttccgaactttcgtcgttgttatgatacttcaggttacggttattcaggtagctgtggctcaaagtgaccgactgtacatgtggtccggcataatggcgatagacacctcccagcgtaaaggtttcctgattaatcttcggcagataccccaaaatgtattcggcatcctcaccttcgatgtcaaaattcagtttcatgcggtcgatacctcccaagccgagcagggtaagttcattccgatcgttaaaacgggttttcaacttaaacgaagcatccgtataagccggaagcaacggcaagcccaaaaccttgaaaagcatctgcaaatacgactgacggacagatactagataagaggttttgtcgcccagatgtccgttggaagtaagtgatacttccgaagctcccagtgttgccttcacggagttgtgctccatatcaccgtcgcgcagactgaaatcgagcaccgaactcagtgcatttcctctgttggctggaaaagctccgctgtaaaacttcacatttcgtatcagatcggcatcaatcagtcccaccggacctcccgaagctccttgcgtactaaagtggttaatattcggaatttctacgccatccagataaaaacggttttccgacggtccgcctccgcgtacaatcaggtcgtttcgatagccaatcggcgaaaaggccactcccggataattctgcactactcgcgaaatatcacggttcgccccgggagctttctctatttcctgcaagccgataacccgaaggctgaccggactctcgggtacccgctgaaaaggagaggctgtgatggttactccttccagctgcgttccctcctcctccatttctatctgtatgtgcggagtgcggtgattgacacggtattcggaagtaaagaccgttttataccccaacatagaggcttgcagacggtaaattccgggaggaacctgctcgaccgcaaaatgtccttcggcatctgtagacgagcctattcccaagccgactaccagcacattgacaaactccagcggctttcggcttgtcttgtcgataaccgtaccttctatccggtaggtctgagcatgcaccagcatacaaacagccaggagcatgaagaaagtaactgttcttttcgtcataatatcttctttagggtattttataaatcaaaaaagccatcctgtaaagaaggatggcttttattcttgtgtatatctataggaggaggtatcaagctttgccttcccaggctttatgaatactttcggcaatggccttaaattcttcatcgctcaatttcaacttcggattagagaagagcatgtccgattccttctgcatgggaatcagatgaatatgagcatggggaacttccagaccaatcacagcctcacctactttacgacaagggaatgccttctgaatagccagtgccacatgtttggcaaatacatgcatagcagccagttcttcatcactcaagtcgtaaatatagtcgacttcgcgtttcggaactaccagggtatgtccctttaccaacggatttatatccaaaaaagcatagaactgctcgtcctctgctaccttgtagctgggtatttcgcccgcaacgatcttactgaatatagttgccataatctgtatatattaaaaaaggcaagcctgcgacaaagcagactcgccttatagttaaaacgatattcctgttacttcaagactgattttaccctgcgggattgtgatttcggcaatatcaccgacctttttgcccagcaaaccctgtgcaatcggagtatttacagaaatctttccctgcttcaggttagcttccgtttccgatacgatagtgtatgccatcttcatacctgtctttacattcttcagctctacgcggctcagaatctgtacggtatcagccttcaacttcgatgtatcaataatcttcgcatcgccgatagttgccttcaactggtttattttcatttccagcatgccctgagcttccttggcagcatcgtattctgcattttccgacaagtcgcctttatcacgagcctcagctattgctgctacgattttcggacgctcaaccgactccagttgctttaattctgctaccagtttctggtaaccttcttctgacatataagccatagtttttcctccttgtattttcgttattaattaaattgttcttgcttataaaacaaaaaagaatcccgatacacatagatgtatcggaacccttctctgttatgactttggcaaagatacgcctttttacgatatcagtcaagtatcaaagcgtactatttttacatgcttttcaacatgttataataatttcttaattgcttcttccagattggttttctctccgattcgcatgctcaactcgttatttcggctcacgagaaaagcagtaggcaacttggtcacaccgtacagatttacgtaagtcgaataaggtccttgcgggtcgcgtacacaaatccacggcaggttgtcggctgctgtcttccagaaatgttcatcggtatcgagcgagatctgatagatttccagtccttgtggagcatacttgtcataaatctcacgcaacaacaggttacgtgctcccgattctgcactgccgtatgctgtaaagtctatcagtacaacctttcctttcaagtcggtaagatggcgggtcgtaccgtttatatccatcaaaggtatatcgataatagaagtttcctgaattttatcggctggaatatccaaaggtttcacctgtggcgcacgagtatttttcataccctttatgaccatattatataagttacgcgaacggtcggcatgcggatacaggttgttcatgcttgtagcaacggctgcaaagcacttcacatcctctttgttattcaacggatcgaaaatcatatatccgttcagtacttggaacaaagcaaaataagcgtaaggtttattaggacctacaaaaatataattccgctttacattattcttatacgcattcaccatgcgggaaaggctatcttgtacaatgccaaccggaatgcccgactgcgcaagcttattaacacgttcctgcaaatcggtttgcagcaagaccagttctttaatcttctggttgctctctgatccctgtatattataatctgtcgcaaagttcttataatccgctttcacctcaacggtttctgtagaatctaccgagaagtttatgactttgtcctcgattctcaaccgatagaaatcgggcgcttcgggacgcgcagcagaaaaactaaaagttccattacttcccaattccacagaatcgagtgcaacaataccatccagaccagtctgctccagatacaacattttatcggccgcatcggtcacttctccctgcactttaaaagcaggctcgttgttgcaggccgtaacgcctgcgaacaacagagctgcagcgatataagcatttcttttcattagcgattattattcatttcgggatgcaaagatacggctttttacgagttcacaaagtttttattcaagttcttacaaaatgacatattttttttagtccgattatctgtccatatatataatgtaagacttggaatatacagaataatagaaaaaggtgaacagaataaaacttttatctcattttcacccgattactacaataatatttgtatctttgcgcgaactttaagaagacttttatattaaaacattttttatgatcaatcctattgttaagacgatcgagttaggcgatggaagaaccatcaccctcgaaacgggaaagctggcaaaacaggcagatggtgctgttatgctacgcatgggtaataccatgttgctggctactgtttgtgcagcaaaagatgcagttcccggtacagattttatgccgcttcaggtagagtacaaagaaaaatattcagcattcggacgttttcccggtggctttaccaaacgtgaaggcaaagcttcagattatgaaattctgacttgccgtttggttgaccgcgcactgcgtccgttgtttcccgataacttccatgcagaggtttatgtaaatatcattctgttttcagcagacggcgtagatatgcccgacgcactggctggtctggctgcttccgcagcattggctgtatctgatattccgttcggaggccctatctcagaagtacgtgtagcacgtatcgacggtcagtttgttatcgacccgactttcgaacagctcgaaaaagcagatatggacttgatggtagccgctacctatgaaaatatcatgatggtagaaggtgaaatgaacgaagttagcgaacaagatttactggctgccctgaaatgtgctcacgaagctatcaaggtacattgcaaggcacagatggaactgatggaagaagttggttctactgtaaaacgtgaatactgccacgaagaaaacgatgaggatttgcgcaaggctgttcacgatgcttgctacgacaaagcttatgccattgcagcatcaggaaaccacaacaaacatgaacgtcaggatgctttcgatgctatctgtgaagagttcaaggctcagttcactgaagaagagctcgaagaaaaagcacctatgatagaccgttattatcacgatgtagaaaaagaagccatgcgtcgttgcatcctcgatgagggtaaacgtctggatggtcgtaagacaaacgaaattcgtccaatctggtgcgaagtgggtccgttgccttatccacatggttcttcaatctttactcgtggtgaaacacaatcattaagtaccgttactttgggaactaaacttgatgaaaagattgtagacgatgtactcgaccagcataaagaacgtttcttgttgcattataacttccctccgttctctacaggtgaagcaaaagcacagcgtggtgtaggccgtcgtgaaatcggtcacggacacttggcatggcgtgcattgaaaggccagattcctgccgactatccttattgtgtacgtgtagtttctgatattcttgaatcaaacggttcttcttctatggctacagtatgtgccggaacattggctctgatggatgcaggtgtacctatcaagaatccggtatcaggtatcgctatgggattgattaaaaatgccggagaagaaaaatatgctgttttgtcggatatcctgggagatgaagatcatctgggagatatggacttcaaggttacaggtactaagaatggtatcacagcaacacagatggatatcaagtgcgacggtttgacttacgacattcttgaaaaagcactgatgcaggcaaaagaaggtcgtgaatatatcctgaacaaactgacagaatgtattgctgaacctcgcaaggaactgaagccgaatgctccacgcattgaaacaatgactattccgaaagaattcatcggtgctgtaatcggcccgggcggaaagatcatccagggtatgcaggaagaaaccggtgcaacgatcacaatcgaagaagtagacggtgtaggccgtatcgaaatcgccggaaacaacaagaagactatcgacgatgctgtacgcctgatcaagggtatcgttgctgtaccggaaatcggtgaagtatatcagggtaaagttcgctcaatcatgccttacggtgctttcgttgaattccttccgggtaaagacggtttgctgcacatctctgaaatcgactggaaacgtttggaaacaatcgaagaagctggtttgaaagaaggtgatgacatcgaagtaaaactgttggatattgatccgaaaacaggaaaattcaaattgtcacacaaggtactgttgccaaaacctgaaggtatgggagaaaacaatcacccaaaacgtgaacgtaagcctcagcagaacaaggaacagaaataatgaatccttcatatctttactaaaaaggttgcccttccggcaacctttttttatgcaatcaaaataaatcgaatcacaagtaacaagctgaaacaccgctatgcatcagcagactaccagtaacaaggagcaaatatgcagacagaaatagcccgacttgtctcggataaatccgcatacaagccgggctatattatatctttcggtcggaaattattctgtaacttcctggaaatcttcttttcctacgccgcaaaccgggcaaacccagtcatcaggaagatcttcaaacgctgttcccggagcgatgccaccatctggatctccaatttctggatcataaacccaatcacatactgtgcaaatgtactttttcataattttatcgtttattctaagttagtatttattgttactttactacaagaacaaatatagaaagaatttgtttatactgtttcttttagtaacatattttttaattcttccattccttctgacgctcctttacgaataacatgtactttccgccctgaagcaatcgctacttctttcgggtcgataagatacacagggatacgtgaaggcacataattcagtaatccagcagccggataaacatttagggaagtaccaataataacaaagatatcagcctgttccgcatagtcgattgctgtttcaatcatcggcacgctttcgccaaaccagacgataaacgggcgcaactgtgaaccgtcggcagccgtatctcccatcttgacttcgtattcttccggcttcagttctttgataaatttcggattattaggttgccaactggatgtcacctttgtcagttcgccatgcaaatggataacatgatggctgcccgcacgttcatgcagattatcgatattttgcgttataaccgtcacatcaaaaaacttttccaattctgctatcaactcatgcccccggttaggcttcacagtcagcaactgcttacgccgttcgttataaaaatcaattaccagtttcggattggcagcatatccttccggagtcgcaacctgttccaccggataacgatcccataatccacccgaatcacgaaacgtactaatgccactttcagcactcatacctgcacctgtgagtattaccagctttttcatacactaatattttcgttctattttagatacaacgacaaaaataagaatttttaatcgcttaaagcggctcatattcaaagaaaagagatacctttgccatgctttttaagaatattacatactaataaatataattacatggataaattcagttacgccattggtctgggtataggccaaaatctgttaagcatgggtgcccgcggcatcgaagtaaacgactttgcacaggctatcaaagacgtattagagggaaatcaaacagctatcactcatactgaagcccgcgatattgtaaacaaatactttaccgagctggaagaaaagataaacgctgaaaacatagcaaaaggaaagcagttcctcgaagaaaacaagaagaatccaaacgtagtgaccttgcctagcggcctgcagtacgaagttatcaaagaaggtaacggaaagaagcctaaagcaaccgaccgtgtacgctgccactacgaaggaacactgatagacggcactttgttcgacagttctatcaaacgtggtgaacctgccgtatttggtgtcaaccaggttatcaaaggatgggttgaagctctccagctgatgtcggaaggagcaaaatggaaattgtatattccttctgaactggcttacggtgcacaaggagctggtgaaatgattcctcctcacagcacattgattttcgaagtagaactgatagaggttctctaaataaaagagatagataaatcgtaatttaaaaaataaaagtaaatgaaaaaaagtactttaatcatgatgtttgcagccgcagcaggactggcatcatgtacagctcagagcccaaaagcaaacatgaaaagtgatgttgatactctttcttacatgatgggtgtcagcaatacacaaggattggaagaatatgcaatgggacgtctgggtatagactcaactcacatggccgacttcgtaagaggtatcgaagaaggattaaaacaaaccgatgctaaacaaaaagcttacatggctggtatccagatcggacagcaggttagcggtgatatgttcgatgctatcagcagccgtattttcagcggagattctacacagagtctgagcaaagaaaacttcctggcaggtttcgtagctgctgtcaagaaacaggctatggttcctacagactcagcagttgtatatgttaacacaaaagctgaagctatcaaagaaaaagcattggaaacaaaatacgctgactacaagaaacagaacgaagaattccttgctaagaacaagagcaaagaaggcgtgaaagttactccgagcggcttgcagtacaagattatcacagaaggtaaaggagaaatcccgacagaaactgcaagagttaaagtaaactataaaggtacattgattgacggtactcagttcgacagctcatacgatcgtaaagagccgactactttccgtgccaatcaggtaatcaaaggatggacagaagctctgactatgatgcctgttggttctaaatgggaattgtatattcctcaggaactggcttatggagcacgtgaaaccggtactatcaaaccgttctctacgctgatttttgaagttgaactgatcagcatcgaaaaagaagacaagaaataaactaaaaaaatagtttatattgaaacaggtacgaacacaaagttcgtacctgttttttattctcccaaccgatactcatgcggtgtctttccagtcagtctccgaaaatatttacagaagaaggaggcattagggaaattaagctcatcggctatctgataaaccagtttgtcggaatggcgaagcaataatttggcttcttgcacaacagcttcatttacccagtccatgacggtacgcccacttgtttgtctgataagtgtactcaggtagcgaggggtcaaatataatctttcagcataaaatataatgtttcgttcgcgaatggcgtacttattaacaagtaaaagaaatctgttgaaaacttcttcttgacgtgtgcgttgttgtttgtcttccgacatttcccgcatgcgatatgcatatatctgatgaaacaaggctgctatcagacttctgactatttcacgtggaaatggctcatcatgtaccacatcccacaacatatcgaaaaactgctgaatgcgcttctcttccttctcagccaaatccagctgtacataaagtcttccttgcaagaacatttgcaaaaatgtctccttttgccatccttccatcaaactgttagtaaaggcaagcatctccaactcacaatcattcgacacctccaagacttgaagtattgtcccaggagaagtaactatcagttgttttgcagaaagagtgaactctatcaagtttgccctgacacgaatatagcctgcatgcataagtaaaatacgcccctcagtcagacgatacggctgcccaagcataaaaatttgctcagacacctccagtgttcctttcacagaacgcaccattcctagttctgccgaaacaaaacgataagtattacagggaacagaagacagctcaaatatttgttttaaagccagaagtaaaagattgttctgtttcatcataatataaaggttatttcccgcaaagataataataacgccctataaagttgtaaaatgcgcacattatcgaacaaatagaacatttacagctaccaataggaccttatgaataagcagaaagcaattacctttgtatgagaacaataaaaacaatgtacttatgatacgagtaatcttattctttctgtctgttgtcacagccctaagtataaaagcgcaaatcactctcgacgaatgcaggcaggctgcgcaagagaattatcctcttgtcagacaatataacttgattcaactatccgaacaatataccttatcgaacgcaacaaaaggaaatcttccacaaatcagtttcagtggaaaggtatcttaccaaagcgacgcaacaatcctcccgtttgaaattcccggaattggattcagaggattacccaaagatcagtatcaagctatggtggaaatcaggcagaacatttgggatggcggaaaaatacacttccaaaaagaagaaatagaagctgcaacccgtgaaaacaaacatgaagtggatgtaagcatgtatgcacttcatgagcaggtgaatcaggtctttttcggcattctgcttttagacgagcaattacagcaaaatgctctacttaatgagaacctgcaacgtaacctgaaaaacatagaagcctatagaaacaatggcatagccaatgatgcagacgtagatgctgtacaagtagaaatacttcataccagacaacaacgtgtacaactttccgccaatcgccgtgcctatttacacatgcttgcattgttaacaggaaaagacatcaatgaaaatacggtattggttattcctcaagaaaccgaagaagagaatgacattaccataaaccgtccagaacttcaattgtatgaagcacaggaacaaagcctgtatatccgtcagcgcagccttcgtgccggatatatgccacaaataggtctttttgcccaaggaggatatggcaatcccggactcgatatgttgaaagacaaattcacagcctattacataatcggagcacgattgacgtggaatttcggcagtctgtatacgctaaagaacgataagcaaaaactaaatacacaacggatgcaaatccaaaacaaccgagaggtatttcttttcaatacctatctaaaattgtcggaacaaaatggaaggattgatgccatacggcaacaaatgaaggaagatgatgagattatccgacttcgctctaatattcgtcgggcagccgaagccaaggttgccaacggaacattaacagttacggagatgttacgtgaagtgacatccgaaagtctggcacggcaaactcaagctctccataaaatccaattactaatgaatctatatcaaaaaaagcatcttaccaactcccaaacgtattaacttgttacagccttatgaaaagaaaatatttttcatgtatcaccttattgattctcctgtcagcatgtcaatcaaataccgatttcgatgctacaggaacattcgaagctacagaaattattgtttcagctgaatctaacggccgattattccgccttgatgctgaagaaggaatgcgcctttctcaaggtgaagaaatcggactgattgataccgtccagctttatctgaagaagctccagttagaagcaaacatgaaagctgtaaataaccagcgtcctgatattcataaacaaatcgcagctactaaagaacaactgacaacagctcaccgagaacgggagcgcgttgaaaagttattaaaagctaatgccgctaaccgcaaacagctggacgactgggaagcccaaattagcgtattgcaaagccaacttgaagcacaaatatcctctcttacaaacaatactcaaagtttaaacgagcagagcacttctgtagctgttcagattcttcagatagaggacttgctgagtaaatgtcatattctctctcctatcgacggtacagtacttgccaaatatgccgagccgggagaattagcctcaaccggaaagcctctctttaaaatagccgacactcacaatctatttctacgcgcttacgtcaccacatctcagttgaaaacaataaaactaggtgcgcaagccaaggtttttgccgacttcggaaacggtaatcgaaaagaatatcaaggcaccgtaagctggatagccgacgaagcagagtttactccaaaaacgattttgacggaagatgaacgtgccaatcaggtgtatgccgttaaaatagccgtgaccaatgatggtatcctaaaaataggaatgtatggagaagttaaatttgacgaagaagaatgattatgaataaaggtataaatcctgttatcgaagtacgacatatctgcaaaagctacggaacagtaaaggctttacaagatgtatccctatccatacaacaaggagaattattcggactgatagggcctgacggtgctggcaaaagtacgttattccgtattctcacaaccttgctgaacgctgattcgggtgaagcatctgttataggatatgatgtacacaatgacttccgttacatcaggagcgagataggatatatgccagggcgtttttccctctatcaagacctgacggtggaagaaaacctgaatttctttgctaccatcttccagacaaccgtagcagaacattacgatcagatacgggaaatatacgaacagattgctcccttcaggaaacgccgtaccggagcattatccggaggaatgaaacaaaagctggctctttgctgtgccttgatccactctccaaaagtcctttttctggatgaacctacaactggagtagatcctgtttcaagaaaagaattttggatgattcttgacagactccgcaacaggggaatcactatcatggtatccactccctttatggatgaagcaagaaaatgtgaccggatagcttttctgcacgaaggtaaaataagagggacagatactcctgcgataatattggagcagtttaaagatatactttgccctccaggattagaacgcaatcgtacagaagacagccagacaccggtcatcaaagtaaataatctggtaaaacggtttggtacattcacggcagtcgaccatatctcgttcgaagtaagaaaaggagagatattcggattcttaggtgcaaatggtgcaggaaagactacggcaatgcgtattttatgtggactaagcttaccaactgaagggcatgcagaagttatgggttacaatgtcatcacacaaagtgaagatattaaacgacatataggctacatgagtcagaaattttccttatacgaagatttaaccgtctgggaaaatgtacgtttgttcggtggtatctatcgagttccttccaaagaaatacccaaacgaacagaagcgatgcttcaccgtatcggattatatgaagaacggcatacattggttcgggcacttcctctgggatggaaacaacgtctggccttttcggtcgccatatttcatcgtccgcaacttgtgtttctcgacgaaccgacaggaggggttgatcccgcaacacgacgtcagttttgggaacttatctatcaggcagccgaacaaggaattaccctattcgtcaccactcactatatggatgaagcagaatactgcgaccgtatatcaattatggtagatggacatatccgtgctttagatactcctacagccttaaaagctcatttccatgcacaaaatatggatgaggttttccaaatgctcgcacgggaagcaaagcgaaggaatgactaacattgatttttcaaaattgtacgtaaacaatatgaaacagtttatagcattcataaaaaaagaattttatcacatcctgcgtgacaaacgtacgatgctgatacttatcggaatgcccatcatacagattatacttttcggctttgcaatctctaccgaagtacgtaatgtgcagactgctgttctcgtaaattcagctgatgcagacgtacggcatatcatcgaccgactggatgcaagtgaatatttcaccgtaaagtacatagtacattctcccgaagaaatagagcacctgttaaagaaaaacaagatagaacttgccatcgtaatagccaacgatttaaaccgattacgtttcgattccagacaaatacaaatcatcgctgatgcgaccgaacctaatcaggctgtaacccgcagcagctatgctaacggagtattgaccaaagcactggcagaattgggactgaaacatcaagtaaacaaaattatagtatctggaaaactactctataatccgcagatgaaaagtgcctataactttgtgccgggcgtaatgggattaattttaatgctcatctgtgcaatgatgacttcaatatctatcgtacgtgaaaaagagaccggtacgatggaaatcctgcttgtatcacccatgaatccaatatgggttattttatcgaaaacgattccttacttcgtactgtctattattaatttgagtacaatcttgttactatcggtctttgttcttaatgttcccattgcaggaagtttgctcaacctgctgggagtatcacttctatttatttttgtatcactagctttaggactgctcatttcgtgtattacccacactcaagtagctgccttactcgcgtcggcaatggtactactgattcctacgattattttatcaggcattatctttcccatagaaagcatgccagctcccctacagtggctatcctgcataattccagcacgatggtatgtagccttagtacggaaactgatgatagaaggtgttccactatcttatgtctggcaggaagtccttatcctgctgcttatggctgttatacttattggtatcacaactaaaaagtttaaaaaccgtttagaatagaataatatggtactacgatatcttattgaaaaagaattcaaacagttgcgccggaatagtttcctgcctcgactcatcctgatatttccctgtgttatcatgctaattatgccatgggccgcaacattggaaatagaggacctacgtatagccataatcgatcatgaccatagtccttcttccattcgactcattcaccgtatagaagcttcaccatacttcaaactgatgactcttcctgatacatacgaaaaaggattggagaatatcgaaagagaccgagttgacatgttacttgagatacccaaaggtttcgaaaaagaacaagttaacggacggtctgcttcagccttgatagcaataaatgccgtaaacggaaccaaaggtggcttgggaagtacttacctgcaacaaatacttaaccctcaaagtacatcgccttcaattctataccgttttaatccacatctggattacaaaatattcatggtacccgctctaatgaccatgttgctggtgatgatttgcggctttctaccggcattgaatgtagtcagtgaaaaagaaaaggggactatcgaacaaatcaacgtcagtccagtcagtcgttttacattcaccttagccaaactgctcccctactggtttatcggttttatcgtattaaatctatgcataatactggcctggataatatacggattagctcccgaaggtagtatattcaccatttactttgcgacattgatatttgtcttagtcatgtctggattaggactggtcatatccaattattcatctactatgcaacaagccatgtttgttatgtggttctgcatgctgatattcatcttgatgagtggattgtttacccccattagcagtatgcctcaatgggcacaatacattacttatgccaatcccttacgatacttcatggaaatgatgcgtatggtctatctaaaaggaagcaatatggccgatatcacacaacaattaggtgtattatcctgtttcgcagctatattatatggatgggccatttatagctatcggaaacaacaataaattctacttcaaattatcctccttcttattgtacatattcctataatccttaggtgtcatctgataatgtttagaaaactctttataaaagtgagaacgatttataaaaccagttttatagataatttcctgtaccgtcaacgaggttgttcgtaacaatttagcagctaaattgatacggtattcctttatataatccttaggagaatcgagtccgatttctttgaagcgacgatataaagttcggacactgacttgcatatattcggccagttcttccaatgaaagttcttcagaatcgacatgattctctatatattccgtaaccttcaacaagaactctttatcttcagccttcaccaaatgtccgtgtgaaaaatcataggcacaagcagaagaattaaaataatcttttaacttactacgattttctattaaacgtactactatagctttcagatagtcaatctcgaaaggctttccgatataagcatcggcacctgcatcaaagccaacaatcttctcctgactcgaattctttgcagatagaatgatgacgggaatagacatcgtatacttattctgtttcaactgccttgtaagctcaaatccatccattcctggcatcatgacatctgtaatgatcaaagagggcgtttcatttttaaccttttctaaggcttgttctgcattttgggctacaatgacattaaaatctttagagaaagactcctgcaagagtgctaacatctcagtattatcatctactaccaatattttattctcagcaatatccgcacctttttcggtactattcagagcgtcgacagacacctgaggagcaacgtttacaggcggcgtaacatccgatacggaggagtcattttcttttttatccagtgtcaaatccaacatcggaagcaatacgataaattccgcatagcttccatattcactctgaatctgaatatctcccttcaataattcaaccatactgtggcagatggctagtcccaaaccatttctagaagtcattcctttgatattagaagcttctacgccatccagaaccttatatctgttgaaaaccaacggtatgtcttcttgacgaattcctttccctgtattatatactttgatacgtaacttttgattatcagcaacatcgacagttacccgaatacgtcctcctgcagaagtatatttaaaagcatttgaaattaaattattcaaaatcttcatcagacttctacggtccgtattccaaactatatcttcagatacaacattttctacttgaatattatttcgctctgccaactcagaaaatgaatgaataatgtcattacataaagctgacacatctacctgctgaatacattgtacctgatgtcccgtttccaatctcctgaaatcaattatttcctgaattaaagcattcagacgttctgcattcgccttgatcatcgtgacatatttttgtatatattctgaatgatcatattccaacaagcgttcgcaggggccatatataagggtaagcggtgtatagaattcatgcgttatgtttgtaaagaaacgtaatttctcctcatataattcctctttatgttgctgctccatcttctccagagcaaataatctcttacgttgctgcttcaacaggaaccagcggatacataacaagacagccaataaaattaacaaagcataaatgacaatagccaacgtacttaaataccacggagcagcaatcgttatatatacagaatatatagggctaacttctcctgtagcctgatttttataacggatttcaagaatataattaccatatctcatctgagtaaaggaaatactattattggttccattatcgacccaagccatatttttatccaaacgatactggtaactataatttgttggatttacataatccaaagccaggaaagatatcgtaaatgtattttcatccgatttaagcgagagggatggtttatcatcccaactctgtaccccagcatgttttccctgttctcccaagacataaacattcgtaaaacgtaatggaggcatagacacttcctgatcaggattatacattgtattgttggtaatggtaacaaagccgtttattcctccaaaaaagagtatattatttcggcagaatgaagctccgtcgctaaattcctgcattttcagtccactacctttcccataattttggaatttattcgttaaggtatcaaaacagatgagtcctccatttgttgcaatccataatttttgattctcatccagaagcatagtatgtatagtactatttataaatcccgtctgctgattaaaaaaggcttcttcattctgcccttttttgattaacccagccccagtaccaagccaaacccccttttcattacgcattatggaaaaaatatcatccaccaccctacttgaatatttattctttaaaggaatagacaccaaactatcaccttctatatgaaagagtccatatcctctattaccaaaccaaatatttttttgattatcagcgagtaaggtaaagaaataattcgatgaaaaatttccatgatcaatcgtataacgcttcaatgaacggatatatggcactcctgatcggtccccaattaatgcccgaacaacccctgtacccacagtagctatccaaagcaccgaatcgctttcttcataaatagcatgaacataattgataggctccggagcaagaacacttctaatcttcttgtctcgatatgaataataactaattcccgcatcatgccctatccaaaacaaaggtttactactctttgcaaatgcatatatagaattgttaaccaatccaccagctaaagaatttattaattcggttcgatattgcatgttatatttttgaggagagaaatcgtaaatcttcaaaataccttctcctttagtccccaaccataatgtaccttcgtcatcccaaaagatagaacggacaggtttccctatactatgatttaaatcttcataagtcacagatgaaatggaatattgtccttcggagtaaatatatactccctgaccatctgttgcaatccaaacaatatcttgaaaacggtctttcaggattcgaaaaactcccgattttatacccaaatcatctaccgtatatttgttattagactgtagggaaatcttcaataaaccatttgtctgaaaagcaataaagaaagatgagccgtcacgaaggatatctacaatagttcctcttccatccaatgtttctttccagttacaaatgagtttcttaacaggcttatctaagctacacccaaataaattataatctccgtccaaccaataaatctgatccttgcctccaaatccatagttcacctgcgttttttcacaagtattgatggatgaaagcttatattctccatcctgagagcggtctatctgatagtagacaatttcatttttcaggaaaagaaccagaaaatgttcgttcacataaagattgacaatctcctcccgattcaaattccttataggtattttataaaattcctgcttcttttcattaaaagcatatcactactgtccaataaaagttggttaatgggcctttgaaattgttgaaatacagtctcttaagcagtattttagaatgaaacggatttgaattcgtagcttagcggtcaaattgaatgccgcttatgaaccaagataaatacgtattcgctcaacttaccgcttttatgaacagaacacaattcaataactttgttcgcaagtataatggtaatcgctacgtgaaacaattcacctgctggaatcagttacttgctatgatgttcggacaactgagcaatcgtgagagtcttcgcgacttaattgtagcttttgaagcgcatcaagccaagcaatatcatcttggtctgggacgcaatccaatagccaaagccaccctcgcttatgctaatcagaatcgtgactacagaatctttgaagacttcgcattctatataatgaaggaagcttgtgaaaagcgagcgaccaacatcttggatattccagggaataagtatgcttttgattcaacaactattccgttgtgtctagccacatttccatgggcgaagttccgaagaaagaaaggaggtgtcaaagctcatgtcttatatgacattgaagcacaagttcctgccttctatactgtaaccacagcatcgaagcacgactctacagcgatgtgttcaatccattatgaaccaaatgcttattatatattcgacagggcttatgactcttttaaggaactatataggatacacctgacaggttcctttttcgttgtcagagctaagacgaacttgaaatacacaatggttaaatggaagcgtaggatgcctaagtatgtacttacagatgctgaagtgaaactgaccggatacctctcagagaagaaatatcccgagtcattccgactcattcgttactatgatgaagagggtgaccgtgagttcactttcctgacaaacgcaacacatatttctgcattggacgttgctaatctctacaagaaaagatggttggtcgagctattcttcaaatggctcaagcagcaccttaaaataaaaagattctggggcacaacggaaaatgctgtccgcattcaaatcagtgtagcaatcatcacttactgtctagtggctattgtccaacacgatatgcaattgaagcgctcaacttatgaagttttgcagattctaagcatctctctaacggacaaaactaacttgcgtgaactgttcgataagactgatttcaacgatgtcaaagaactcgattatcccctttttgaaggactatttgattaattttttaactagtccatttttattggacactaatgaaagcatataatgaattactactcgaaaaaaagaatagatcgccaagttcgttttttaccatcatatagctacccttaaactgaggatagtctaccacaagacgtttgtctttatctactttactcaacccataattggtctgtacccagattactccatcatgggtttccaatatttcttctatgatatatccagacaagttcagttgcccccaaccgttccaactataagccttaataccatcgtatatatttactccatcacaagttcccatccatacaaacccattactatcttgtaacagcgaaagtacagcgctacttgtaaggccgtctgcatttgtaacttgtcttatattataagctgataaagaatttattacacataccagaaagaaaagcaatccacttataaatttcattactgcatttatcatagtatcattttgtaatcaatatccgaatacaaaggtatagaaaataatagattgcatagaaagagaggtataatatttgtgcgtacatcaactaaaatttcaaccaactattcgacttttatatttatcaattgacaatctgtaaaacaaaaataattggtataaccaatatctatttttatagttctcccacaacttctcccactaaaacataaaataacaggtatggaacaatgctttaccagcatgccccataccccaaaaactatttaaccgcagccttttctctgttatgaatatattccaataaaatagaatgagcaggatgtgacatagttccatgatcaaaaccttgcaactcatagagttgtacatccggatgacctataattttaagcattcgccataaataggcattctcttcatagcgtcctaacatctcacgttcacggtctccacatatcaatattacgggaggacaatctttacgtacatagtacaacggagcatgttcatcaatcaaaggctggtaatcggaaattcctctatcacgtctattctggaaatgagtaatagcttgtccgctaaaaggaataagtgcagcaaaactatccgcatccacaccatatttcgctaaacgacttttatctaatccaatcatgctaaccaaatagcctcctgcagaatgtccagacaaatatatttttgaaggatttcctccataacgagctatattctccataacccatgcagcagcagctgcagcgtcatccacagcatcatccgtcgttacatcggcattgattgctttcggatctttgttacctgcacataaacgataacttacaccaacaacagcaataccttgctcacgcaactcacgcgggatctcacggtcgccaaccgtcaaacctccaccatgaaaccaaactacagttgggaaatccttcttatcagtcgggtaatatacgtcgagtacacacttctgcttcatgtagctattcttatattccgtacggtaaggaatagccttctcccatttataattctgtgcatgaagcacgatagaacatgccaataagacaagtatgcaataaaattttgtacgcatctgaattatgtttatttgttatttaattgtaatctcaactccctctgccaaattaccactggcctgatatacacccttgtcagtgataacctttacaatggccatatcattattttctgtaatatacttaccttctttctgagccaacttaacaactactttattgtcagctgtacaagtggccgtaaaacgttggaaactataattgccatctttaaacgaccaattatctccttcgtcccaataaagagtaccacatgccttgcctttatcatctagacaaactaataaagtcagcggatcaagagatttttcagttgtgttctgtataatctttccggtagggataatagaaccaccacgaatacttaacttagcctgatacggatctttatcatcaccagaaatcaaagacagacttctccagatacctttaggcagggctggattcttggcccattctggaacaaccagcaaattatctccgataaggaatgcctgttcttccgcacgaagcaatgtatccttaggatcggcaaagaatattggacgcataataggcataccattttccgaagcctcatgcagcaacgtataataataaggcagcaaaacataacgacgttccagtgccatacgtgatatatcttccactttctgaccaaatgcccaaggctctttattaatagtacctgcgcaggcatgtcctcgagagaagggatagaaagctcctaaggccatccaacggccgaacaattcggcatcaggattaaacaagaatccacctatatctgctccactaaatggttgtccagacaatccaagagtaagtatcatagggacagacagcttcatatgactttcccatgaagcattatcccccgtccacgtagcagcaaaccgttgtccacccagaaagttggaacgcgttaaaataaacggacgattttgcggacgtgctttcataataccgtcacgtgatgccttgaccataagaaaaccatatacattatgatacttcaaatgggggccggcaggaatattatctcctcctaagtgtttattgttttcgggcatcgtaccagtaggagtatggcttatttgaggttcattcacatcattccaaactccatcaacacctttgcctataaaatcctgatacaaatccgcccaccactgagccgttttaggctgagtaaaatcagggaaagaacatgcaccgggccaagcatctccatgaaactccttattctttactgtttttacccatacgtcttttgcagtacccgacttatagacaaaataacttgtatcaaccttagcacccggatctatcatccatgcagagtgaaagccacggatatgaaggtctcgattcaaagcagcagggtctggaaatgttttaggattgaatgtaaaaatgcgatagccatccatataatcaatatccatccacatcacatcacaaggaatacgtttgatgcggaaagtatctgcaacctcaatcacacgactggctggcgtataagagaatcgacactgttgataacctaaagcccaacgtggaaccataggcatcgtaccgataagttcggctaacccttttataactgcctgcggagactctctatctatcacaaaaacacgaaacaattctccttctgtttcgaagctaatacgctcattagtagtcgtcagctctgctttgtatggcgtatcaaacaaaatgccaaaagaggtcccatccggacgaactcccataacccaaggatgtgactgatacaaacgttttccgttatcaacactatatgcacctgaatctgtattccacaacttaatactttgtccgtttcgcaacaacggcccagtgacctcaccgccaccataaaggctggtaccttgaggtacatccaaataagcgctggcatgtcctttcttcttttccattacagggtaaaggcgccagtttgaaggtaacatacctttttcctgaggctctgcttttaaggcgaaagaaggcatttgctttaaattaaagccttgtggcataaatttagcaattccctcacccaccatcacttcttttttcattttgacgttatgcgcaaataggcttcctgcaaaacataacattcctataactccaacaatctttaaattcatcatcccaattatttagtatagttattactcgataacaaataaattacaaactaacattttagcactaaaacagatatttagtacaacgtatctgttccccataaaacgctatggtaaccacttcataaaattatagaggctgcaatacacacatcgcttccatcaacatacagccggttaaatgagctgtcaagccaacccgatcattatcggcaggagcttttctccaccgtcctccatataacattgtattgggattaatgccttgagtagccatcacagtggcacaacgagtaatatactcatgaaacttctttctatctgcataatcaacagagtgatcattgatcaacttaacaaaataacggaaaaaaattccatggaataatcctccatccccacttaccgcatcagacaaaactccgttattctgcgacaactgatccactacaaaattcgcggcctttatagcatcatttaagtactgtttatcacctgttattttataaagctcatgagcagcccccaagaaagttccaatgttataagtaaatatccatttcttctgaacctcacctttaccattcatatgatcatagacagctcctgttttacggtcgaacaaattattcttttcccaaacatagattttaatggcttcatttaaatagctattttttatctttccatcgttaaattgagcctgatcgtaaaaagagtaaagacgagcagcaattaaagcagctgggccatttgaacaagcattttttgattttgccacatcagttttccaagtaattcctccataccaaggagcttcatcttctggtccccatgtaggccaaatccagtcatcatatatttgtcttgcctttgctatatactttttctctccagtgctttcaaacattcttatttgagccaatacaatccactccatatcatcgacaaaaacattccaccacggatctttaggattcattttaccagcaaagttgtattgaggcataccttcccaccacagaggaaacaaatctttataccgtgattctccggtacgcatatatgcatcgaccaagacatccatggcatgtgcctgtggccaataattatttgttgacaaatctgaaagatcactaccataattgaaataatagcgtttttcataacctttaaagttagctccccaaaaatgtttaataagcgcgtctgacgtaccattagccatcttattccaataagctatatctttttgagcgaacattcccaaacataaacatagcatcaacagagttgttaaagtctttttcataactaccttttataaaatttcactcaacagtaataacaagtttctttcctttctgtagctgctcatgagatataaagtatccgtttattactttattgtcgtatgttatctcacgaatctttcttcccttcccctgcttcacgatagtaaaaggtttatcgtttaaataaaacttcactttgtcgaacaaagggaccgtaataatataattgggctcggcaggagaatatgtatagagaccaatcgcattaaacacataccatgaagacatttctccagcatcatccatgccagcatatgctaatttgtccttacccatatcataataatgctccatcaaggaatcaagtatcgcttgtgtcttctcttgttttccaataaagtaataagtataaggaataccatgtcccggttggtttccatgacaataatttccaataaatccagtcatattatccacctcatatccacgccatggttcggtaaaaagggaatccaacttatcctcaacagccttattgttaggataaagttttatcattccctcaggatcatgaggagcaaagaacaaagcattccaagcattggcttcacgatacatatactgataatacggataatatggatcaaaatctgtaatccaacttccatcttcaattttcccacgccaaaagcctgtacttgaatcaaaaagagttttatagttttctgtacgcttcatcagcatgttataattcttttgatcacccagttcttttgcaacaagagctactgcataatcatcataagcatattctaccgttttagttacagcacctttatattcatcttgcgtagggacattaactgtatctttctctgcaatccatccacgtttgatatactcatccagataaggacgtcctccttcacccggaacagtagcattctttaaaattaacttatatgctcttttcaaatcaaaattatgcaatccacgcaaccagcttcctgagataaaagtagaggcatgatctccatgaaagaacgttggcatgtacccattactcttttctcctttatctataatagacttaattacatctgtcgttacctccggcgacaacatttccaacaaaactaacttattacgataatcatcccagaatgacggattagtataatagttaaatccattattaaccacattccctttaatgtcagtatattcaaagtttacatcacttcgtaaagcaggccatttgaaagcatgatatagacaggaataaaagagtttcttttcacgctctgttccacctgaaacttgtatcttcgacaaaagtttctcccaagtataatccgcctcacgagcaacctgtgcaaaatctttatgaagcatctcatattcaagattcatttttgcattttcaatactgacaaaagaaaatccaatcttcaattccaacggctttttacctttgctattgataaactttaccaaagccacttcatgtttgtcatccttaagcatggcaacatcctttatggcataattcgttgtcgcgtaaaaataaattttgccttctccagcctgatatcccgtaaagactttatctcctgacttttctatatgccagtcggttactgcattatttgaccgacgaatatcgaccaatactgatttatcatcttcctcactaaacgtatatttatgataggcacatcgcaaggtacttgtaagttcaacatttaccttataccggtccaaataaacctgataatatcccggacgtgccgtttctttccgatgactaaaagacgagcaatagtcactgggagtaacatcacctacgacaggcattatcggcacatgcaataaattccaatgacctttgttggtatgagaaaatccataaatcacactatcttcatattgataaccagacccactccgaaattgtgttactggactcacctgaaccatcgcattaggtaaagttgtcccaggataagtttccgctccccacgttctagtttttttatgacgttcatatcccaaatctttcttatcccacaacgtagcactccccaataaaggattgacatattctgtcaatttaccggaactctcacaacttgtaaaaaatatgagagaaattatcgatattaagataccattcttcattctattcttttttattttatctttatacctatcaaaaacacgccccctgttacattacagcactttgtcaatagcttcttttattaatgcttccataacgtcgtatccctctgctgtgggatgaaccccatctttcgtatacttaggattcaaagctccattatctccataaaccatttttgcgtaataatcgacatatggaatcttatgctcatgagcatacgctttgattcgtgcattcagggaagctattttagctttcgcatctttaatagatggattccaaccgaaagaagctgcaggcaatgtcgatgtcaggataacttttattttatgtacttcagccaactctaccattgacatgatattaccaaacgtatattcttcattataagagccagtgttttccgctacatcattggttccagcattgatgacaaccaataagggagatagcttaatgacatcttcccgaaagcgtaacaagaattgagaggaagtttgtccactgataccacgtccgacataaccattatcagtaaaaaaggcaggatggcaatttacccaaccttctgttatagagtttcccataaagactacttttacaggctttgcagaaacagttatatttttattttcttgagcataacgatttaagcctccaaaatcacgatcctgcgcatgtatgctaccacaagttaaagtgataaaagtaattcccagataaaaatacttaactaacatttttgttttcatagctttttacataataaaatttattccaatacggcagcccatccaccattacgtaccaatgtaatatctaatttatcagaactactaacctctcgttcttttctacgataatccatagcttgcctatctgcgtttataccatcctcaaatgaaatcatccgataagttttatgcttatccaagaaatcaaaagacaaagtaaaagtacgagttttttcctttccattacagatagcaccgataaaccatttatcacctttccgtctggcaagcactacatattcaccaatcttcgcatccaatacttttatttcatcccatgttacaggaactttcgtaatgaattctgtacaatctggattacgataatacaacgttggattatcagccaacatttgaactccactttcaaacacaacataaagagcaagctgataggcccgagtaccaatactggcagaattcggacgttctgatctataaacctcaggttgcatactaatcatagccccgggagtataatccatcgcacctaccgcatttcgcataaaaggtaagtacagactattgtccggatagcatcctcccatctgttccataccacgtacaccttcgtatgacaaaatattaggataacgatattccagacctgcaggcttgaacgctccatgaaagtcgatcaataagtgatattttgcagcttctttagccactcgttcataatagtttaccatccattggtcactgcgatccatgaaatcaatcttaataccagctactccccaatcagaaaaagttttaaacacatcaaaatgattctctacagtaagccaagtaagccacaataagacccctactcctttttcttttccataacgaataatttcatgcacattgactttcggattcggtgtatacggatcacgcgtgtccaaagcccaaccttcatccattaaaatataagggatatgatatttagcagcaaaatcgataaagtatttataagtatccatattaaaaccagatacaaagtttacatcaggcccataaggtgtagctccgttccaccattcccagcttacctgtcctggtttcacccaactataatcttctaactcacaaggagaagatagattataagccatttcatttcgtactatatctttatcatcggaagaaattacaaaaaagcgccatgggaaagttcgttttccttctgtcttagcaatataatcagctttcttcagaatctttacgctacgatccccatcttctccaaactctaatggatatcttgggaaaacagcagtcaacccattatcgtctgtacctttcaaaaacatgcaaggataatcatccaagtctgcctctgagatcaatatattatatccttgaggactctctaataatatagggagataactcatttcgtcggatgaatgataatccaatgttcttacatgagaatacggattctcataggaagtcttgaaactggaagtctttgataaatgagccagataattagctgggaaatgcacagtaaactcttctcccactacttcgagctgattcttcctttccgtaacaaagcgataagcaaccccattatcataaactctaaattcaatagcatacttacccttcatattcatacgaagcgtattatagtaattcctaacagacgcattctttaatgggacaggacgtagtgtttctttatctattttccctttcttaaagctctggagatgtggctgtctacccaaaatatcattagataaagtcattgataaagtacaattcttaagaatagtatcattctgagaaataacagaataatatagtttttcttttaaatcaacgacaaccttaagtttaccatcaggagactggatatcaattgtcctctgctgcgcatggatactactacaaagtatccccaaaaatcctaataataatattcgttttttcatagaattccatgatttaaatttcgactaatgaataaagccccatgctccagactcaaacattctatacgatgagtttatgattttgacatccagacataacttacaagaagtatagcctttatgtcccaagtataattataaatacctatttactatttaaatgaattagccgtttttaactttacaatctgtctataaccaataagtaaatttatcatcaaattttatgatgccaatggtaaacaataaaaaataaagatctccttaccatacatatggacaacaaacaatcatatgtttaatgtttaaacctacatttccatggcatctaccaaataagttaaaatcattgattattaaacagttgcaacattttaccccatttatatatgcactgtttgctttcagtaaggaataaaaatattatctcccaatcataagacaaagtgcttttcaactaccgatttaaaattatctttcaggtttaataactaaatcccctttgtaacctttttctatatcaaaagatgaaaatagaaaaagttacaaaagagatttaaatcaagatttcaatacctcaccatctttaaaacacagtatcttcaattatttgccccacaacgctctcgcctctataagagcacatccactagtctgtgcgcccaactcggtagttccaagagcagatgtagtccaattggttccaaataaaatatccaacttatttacacctttacgccacaaaatatctgcattattactaaagaaagtttcaaatttcttacgataaagttcatccaaatcaggctccatgatcaacttaacaaaatagcgcataaatatgcctttgaaaaatccaccatctccagcaccttcatcacgtaagacattgtttccactatcaatcatactcgcatcactaatacagaaataagcagctttacgtgcatcttttaaataagtggcatcacctgtagccttatacaattcgtgagcagctcccaagaaagttccttgattgtaacttaatgaaagggtactgatttctccactttcaccgttcaaattatcataaacagctccagtagctttattaaacagattttcacgcaaccatgcataaatcttgacgccccagttcttataggcttcatcctttgttacagtatacaaacgcattgccaacaaagctgccggaccatttgaacatgcatttttgctccatggctggtcagctctccatgctacaccaccatcgccatattcttcattccagccaccttcaatatagccccataattctttggcagtattcaagtatttttcatcttgagtagtttcatataaacggaccatagtaagggcaatccattccatatcatcataaaaattattccaataggaacctccattttttacttttatcccttcataccatggagtaaacagatctgaatatttagcatttccgctacgcaagtaagcatcaataattacatccatagcttgtgcttgaggccaatactgaaatccagtatcattaccataattttgataattaaagtatccttcctcattccaaaaacgatctggtaaagtagagctggcactatcagcagccgcactccaatctattgcataaccagtatcgtatacatattcatcttcaattttactacaggaagcaaaaagcattcctgtaataaaaaagagtaataaccacctatatttcatagctcaattacttaacaagttctacatgatgtgtataattatctccagagaaaataaccgaaactcgagtaacagctcccggatttgctccatcggcagctccatcgaattcattgttcaatttccatttctgatcccactggttattggcagtttcagttatatagaaatacggatcatctgcagcagcctctcccggattactatctgtagtattcttagttccccacatctgagttgtaccatcggcatatgtcatcaagaatttataacgctggtctctaccccaactttcctgtttgaattcgatgacagattcaccttcgaatacgccattgcctttataaggcagctcaaaagtaacctcattacttggacagaagaagaatcctaagctctgaatttcagtcatcttaacagaagctgttgtaaagtcaaatacaatacgatagatacctcccttgctgacagttgtttcaccctgaccttcgatgataacgccactttcatttacataataagatttagcatcagcagagttattatcaaccagtcgataagactttccttcttccaatttagtaaatacttcaaatacacctaattcatctggcatagaacacggtactgcttttgtaatctctgttccaccttcagttgcttcaccagtcaaataaacctgattaggcagttcagtaaatcctttcagacaagtaatagtaagagttcttgattcagtagccattgctgaatttaatcctctggaagcaacaacggtccattttaaagtaccagtttcgccaccattaataccggctgcttttccaattttatccaatactttatgagtaattgtagcataactacgaactccattgttatcggcaacaacacgataaaccggatttgagaaatcaccatccactttatcaaaaacaacttcatacaatggcgagccactgtcttctgctttagctgcagcccactcaaagaaaagtgaagcggtagatgaagcaaccaatgttacactctgaccatcggtaggttcatacagttgagtaacaggactaacctgtgcatccttatattccatatctttagtacatgacgtagaaaacaacaccgtcaagcacattacaaatacataaaaaaatcttggtttcatcattataagtatttaaatattcaaagttaatcaattagcatatcccggattatttggagccaaattatggttcaagtcgatctgagtctgaggtacagcccacaaatagtctctttgttcattaaagctataagagtctacacgaattgtgccaacaccttcaaaagtagctccattcacatcaccattcaaatattctgaaccagctttccaacgcttgatatcgaaccatctcagtccttccattgccaattcacaacgacgttcattacggattaattgtctcatatcatccgtagaaagagaaggatattccaatgcaccctcatcagtaaatccagctctctctctgatacgcttaattgtcatatcccagatatccttcgtaaattcacctttctcgaattttgcttcagcatacattaacaatacatctgcataacgcattgtaatgatattcaggcctgaattcaaatcaccagcatcctgtggactataatacttacgtacatagtaaccagtagctgtgttattactaccatatacatacttatcgacagtggttgaagtactcggatcgacatgtataacagttcctacactaccatcatttacgttaccactccaatcatagccatcgtatacaattgttgccgtcatacgtggatctctgtttgcatatggataatctgcagtataaccactaccagcttcattgattctcttaccgttcagcatgatatagctatcaaccaacgactgctgaggaacacggttaattgttctacctcccacactcaacggagccatatcgcccatatctccccaagtcaaaagtttctttacatacgaacgatccaagattacttcctgattatgctcattctcctcttcaaacaatccacggtaagaaggaaacaaatcataagttccatattcaccctgattgttgatcagattatctgtataggtaattactttatcccagtttccttccatcaagtatacacgtgcctgcaacatgcttactgcacctttcgtaattttaccctgttcgtctgccgataaagcagtattaattggcagatcatctttaatatcttccaattcatcatggataaactgcaaaactgtagcagcaggagtacgacttattgtattagcctcatccaatgtaatatcctttgtaaagaacggaatatcaccataaaaattaaccagacggaaataaattgcagcacggataaagcgaatttctgctatcatacgagcttttgcagaaggattcatgttaggaatcaagtctactttatctagaaaaacatgacaagtcttaattcctccatacaaactttgccattcacttgaaaaaacgccaacagaaggagtagcctgtcccttacgaatagcacgctgatcggttaccgtacgaccatctattacattatcgctcaaactttcatccgaccacattttcccagcatcatacatctggctgtacgccatattaaccacattctgtgcttttgcctccgatgtccaataactgttatcggtaaatttatttgtaggtacattttccatgccattgcaagcagacaatagcaatactgcacttacaacatacagcatatatgtttttaatttcataaaatcacactattaaaattctacatcaataccaaagccataataacgcaatgtcggataagaacgtccactgtttgcgccttcggctgacattttagagtcgaactcagtagattcaggatcgataaagctattgttactaaatgtcagcaagttatcgccacttacatacactctaagcttttccatgccgatcttttttgaccaagtcttagggaatgtatatcctattacaacattcttcaaacgcatatatttaccatcaagaatctgcatgtcagaaccagttttataattatttttattcgagtcagaacctggagctgctagacgaggccaggttgcatccgtatttgtcggagtccagaaatccagctgatgtttgaatatattatatgaataattttcatgaaatggttcaatcaattcaccacgcaacatcatatcacgctttccaactccctgccagaacatactgaaatcaagtcctttccaagacaagttataagtgaatccgaatgtataccgcgggaatgcgttacctaaaatgtatcggtcttttgagtcaatcacaccatcattatttctatctacaaatttcacatcacccggctgaaccttacctccaacaggaatagcagaagcttcaatttcttcgtagctctggaagtaaccatcggtcttataaccatagtaagagttcaaaggtacaccttcacgaataatacgttccagttcattaacttttgtaatctgttcgtgacctggataagttaagaccttattataagaatcacttaaattgaaactaaatccatgttgaacttgtcctgtgcgtacgttataattgataccgatttcccatccttggttctgcatctcaccaatattatccataggcatatctgttccaaaaacggtaggaactataggcttcatcaaaatatcagttgtacgtttgtagaaataatcgaatgttacattcaactgattcttgaagaatgaagcatcaacaccaatattaaatgtttttgttttttcccatgtcaaatcattcaatcctaaggcgaaaccagttcctgaaacaaccgaattaccataagcataattattatcgtatacggtataagttgtaaaacggtcataagtaccgatagcctggctacccaagataccaaatgaagtacgcagtttcaaatcaccgactttttctttatagaaatccataaagttttcttcagacaaacgccatcctaaagaaacagaagggaagaaaccccatcgataatctttatggaatttagatgaaccatcataacggaaactaaattcaccataatacttatcagcataagaatatccgacacgacctaaaaaagaagtaagactggtacgattggtatcatcaacagaagtctttcctgtaatgttaccagcttctcctgtagtagtatctgtagcgatacctaaatcaggatcaacatacttcttttctatttcattggcagtataagtatacgattcgttcgtcacacccaacaatccacttactgtatgcttaccaaacgttttattgtaattcaacaacagttgggtattgatcagatacgcatcactattccagttacttgacttattgttagccaaattaaccggtcttggagtagtagcatcttcacttgcataatatgctacagcattatttctcgtaaaacgtgtatcgttgataacatctgctcccacaactcccttcagagaaaggccgtcgataatcttcatttctgcagaaacatttgcattcaaataattattacgatacttattatatccacctgcttccaacgatccaagagggttaaattctgacaagatatcattcaacagataacgaccatctgccgatttcatcttgtaatagtaataagtaggaacacgttctgcatcaatttccaaactaccacccgtcgtactgatactattattacgcgtatatgcaagaattgcgttcaatttaaagcgccccacttctgtattgatatttgtacggaagttataacgttctactccaaaatttttattgcctacatagttactttcctgatcaaaatatcccatagaaaccatataagtagtattggcagaacctccagatacacttaagttgtaattttgctgtaacgctgtgcgcataatttgatcgtaaaaccaactttcttcactctcatgagcagccaaatcacgaatctgttccggagtgaatttaggatcacttcccacattggtgtaagccaagttggttaacgttgcattctgccatccagcaaccggagagaacagaatatcaggattctgccatccaacagaaccacttaaacgaacggtcggcttttcatttttcttaccagttttagtagttactacaattacaccatttgccgaacgtgatccgtaaatagctgcagtacctgcatccttcaatacagagatgttctcgatatcgttagggttcaacttattgaagctaccactatcagatacgataccatcaataacaatcaacggactattatcattcagggtactgataccacgaatattaaagttcgttttgttatcattagggttataacttgtctgctggacaataacacccggagctgcaccctgcaaagcttgtgtcacatttgcaacaggacgcttggtgatggcttcagacttaacctggctgacagatcccactgcacttttacgggtagtagtaccatatccaattacgattacttcatccagctgttcggtatcttctttcaatgttaccatcagatcagatctatttgcgacctttatttctgtcgttttatagccaatgtaagaaaaagacaacacacttcccttttcacactgaagagtaaaattaccatctatatcggtaactgttccctgtcccgacctacctttcacagaaatgctgactcctatcaacggctctccatttacatcctttacatttcctctgactgtcatcgcagcctgttgtgatactgctgcagaactactctctgtagcataaagagtagtagcagaagaggttaatgtaatggccgccagagcagctaacatttttaaattagtattcatttttattgatttaaagttatgcatattctataatgctttagatataagacaaataagagaaaaatacacctatttatcttatcactttatgccattcaatacatccaattttccatcagcaatgagtttcagaatcaattctccaaacaacgtattctgccatgcaaaccaaggacgcgtaaacttttctgcattatctttatggaaagactcatgcataaaacctgtaccagcgtccgtactcattaacatttttacgcacgactgaatttcattatcatcctgactagtaaaagctttcatcatgatactcataggccataccatatcataaccaatgtgaggaccacctataccttcacccgctttccctttaaagaagtaaggattatcttcactccagacaaaacgacgagtattctgataaataggatcatttatatctacatcgcccaaataaggcattgcaagcaaactaggaacattcgcatcatccatcaacagatagttcccaaatccgtccacttcataagcgtaaatctttccatacttaggatgattatagattgcgtattttttcaaagcaccttcaacttcattagccaagtctgtacattgtttagccaaatccgtttttttattaacctgctctaatatttcggctgctttccttaacgaagttacagcaaagaaattagaaggaataaggaactggaaagtagaagcatcatcagaaggacggaaagaagaagcaatcaaacctacaggcttcactggatttccccatccatcattcgtcatagtatccaaggcacgttccgtttttctttggaaagaatatgagccacgcccatctttacgttgctggtctttgaatgtagacaatatattttgaattgctgtcatccataaatcgccaaaaacagaagtatcacccgtaaccttccagtagtgataagccagacgcaaaggatagcacaaagagtctatttcccatttacgttcatgaagctcaggcttcatatccgttttatcactcatccattctcccccaaccggaccatcattaaagccattcgcataaggatcaatattgatacatttccattggcgaaggatcacacctcgtaacatctttttcagttctggatcctcattagcaaaatctacatagggccacacttgggctccagagtcgcgcaaccacatggcatgaatatcgcctgtatatacgaatgtatcatcatcaccatcttgcgtacgataatgtacagtcgtatcaagagtattgggaaagcaattttcaaacatccatcttaaataaggattggtcaataattcctttacttcttgtatcttagcctcaacagcttttgaatgaaacaagcgcttagaaaactctggacgttgcgacacatattgttgagtactttcacgtacagccacaggaaatacttctaccaacgaagaagcataaccatcctctgcaatgaaactagctcccataagtgtacacaacaatacacttttcaaactaatcgtatttttcataactattttttataatatatttattttattcttgccagtcttgcatacatttctatcatcgcagcctgagtaagcaaccactttgtttccttattttcatttttcttttccacaaagcaatcatcttcaaacagtctattatgattagcattatgtgcccacatatattgcaaggtattcctaaaatcattcaaataaacaggattatgatccactttataaagttcttcaaatcctctcaacataatagctacaaaccaaatattaccattttttattgccctaaacttcttgtcatccgacacaaaattttcaaaaaaatactggctacaagccaaagccaaccgttgtgcttcctccaaataagaattctgctttgtcagattatataataagacggaagcttgcaacatttgtcccgcattatatggaaacttggttttatttacctgaccatccaatgttagattatcataataaaggtaatcggaaggatcctgcaacttctcctttgtccaatcatacaacttcttacccatctcgaaaaaatgcttctccttcgttacagaatataacttcaaagccagtactacagccggagcattcgaacaagtattcttcgattcctttttttgttcgcaccaataaactccacctcccaaaatagaatcacaaccactttctataaaactccaaatatttcgagctgaagctaaacaggcgctatcacctgtttgtttgtataaatccagaaaatccaatcccaaccaaagattatcatcataaaaacgatccgcctttccactttctgtaagataagactgataacaagcaggcacacgcaatgaatcataatagcattcaagtcccggtaaaatcacagattgaatcatctgctcgtatttctggtttcccgtagtttccaataaagcatttagagcagaaaacattcctgaagtaggccataaataagctaccctatttttgcgtatagtatcagctcctgccaaataggttaccagatcaccgtcacgcttaggaaacgtttcataaaataaattccggtcaggaactttatagtatgccagtgtactatctaataaagttgcagcatgatccgaaaaatcgatattggatttctctctatgacatccgcatagaaagaacagaactccaatactcattattaaaatatattttttcataaacttacctttatttaacgttctatccgaacgtgtacaaaggtaatattaccacgccataaatatatatccatctcagacaatcatgtcaactatcaagtgatgtgaattatataaaaaattttatatgtatatacatatgtcatcgatgtatgcatatatgtcaaatatgtaaaatttaacatttctaatacacaatataccatattattacctatatttgaaatacacaaactttaaatacgtgaatattatgaacgcaaatcctgttttcagtttgcacattccaacaagaatcttgttcggatgtggtgagataaagaagttagcaacagaaatacttccgggaaagaaagctatgattatcatttccggcggtacttcgatgaaaaaatacggatatttagataaagtaaccagcttcttgacagagaatgatgtcgcatctatcgtttacgataaaattctacccaatcctattaaatcgcatgtaatggaagctgctgctatctgtcgcgaacaaggttgtgactttattatcggattaggtggaggtagtaccatagattctgccaaggctattgccgttatggcatgcaatgacggagatttctggaactacgtaacaggtggaaccggcaaaggacgtccagttaccaaagcacttcccattgttgccattcctactacggcaggaacaggaacagaagttgatccgtgggctgtaattaccaacgaagaaaaacaagaaaaaataggctttggctgcccgctcactttcccaactctttccatcatcgatccggaattaatgatctccatccccgcacatctaacagcctatcaaggattcgatgctttcttccatgcagctgaaggattcattgccaactgtgcaaccccaatcagtgatctttatgcattggaagctatccgcttactctacaaataccttcctgtagccgtaaacgacggcaagaacttaaaagcacgtgctaaagtagcatgggccagcacacttgccggactggtagaagctacatccagctgtacttccgaacattctatggaacatgccatgagtgctttctatcctgaattacctcatggagccggattaattgcgctgagtgaagcttattttgaaacattccgtaatgactgcatgaagcgttacatgaaaatggcggatatcatgacacagcagaagagtaatcgtccaagcgacttcatcgatgcgctggtacgcatgaaaaaggaatgtcatgtagacgatatcaaattaagcaaatggggattgaaagaagaggatcttccgaaaatggttcagaatgcacgcgatacaatgggtggtctgtttaccttagatccacgtccgcttacagacgaagaagtattgaacatctacaaacaatcttataaataaaggtctcacttagtctgtcaatcatctaaaagagaagcgaccattcacatggtccgataaagtaaaacaaaaagagttcaccccaaggatgaactctttttgctatttaacgtgagttcgatataaagattaaaattatcagtttgaaaattaggaacatagcgataaaagcattaaatttatagtgtctaagtataacatttaagcgattaccactatgttctcagagtctaaagttacggagattttttgtatggcggatgatttttgcaaggaatttgccaaaacacaggaaaaatatatggttgaagaaaagaatcataagcatcggaacaagccgaaccggatgagtgatgcggaaatcatggtcatcttgatcctgttccactcgggaggcttcagatgtttcaagcattactacaaagaatatgtatgcaaacatctgacgcatctctttcccagacgtgtgtcctataaccgttttgtggaactggaaaaggaagtcctgttgcagctgaccattttcatcaaggaagtcctgttgggtacctgcaccggtatcagctttgtggattccaccccgctgcgtgtatgccggaaccaacgcatattgattcacaagacttttaagggtctcgccgaacgtggaaaatgctccatgggatggttcttcgggtttaagcttcacctgatcatcaacgataagggtgaaatcctcaatttcatgttcactccgggaaatgtggatgaccgtgaaccgctgaaacagacaaagttcctgaagaatataaaagggaaactctgtgcggacaaggggtatgtcgggcaaaccctgttcgagaacctgttccttaacggcatacagttgataaccaaagtgaagaacaacatgaagaactccctgatgaacgtggcggacaaaatcctgctgagaaaacgtgctttgattgaaacagtcaatgacgagttaaagaacatcgcccagattgaacactccagacaccgttccttcaataactttattgccaactcgctctctgccatagctgcatactgcttctttgaaaagaagcccgccattgacgtttgttttgtcaaagacggacaactcacgatgttttaatttatttcgaactcacgttatttattattctgttacggcaaatttcaatgtcgatacatcttcgctgttcggaccaatcattacattaaaatctcccggttcacaaacgtaatccaaatcgtaatcatagaatttaagtagttccggagttatcttgaaagatactttcttgctttctcctttctttaaatgtatacgctggaaacctttcaattctttcaccggacgagtaatacttcctaccagatcacgaatgtacaactgaacaacttcatctgcatcataatttcccgtattggtaaccgtgatagaagcagtcagttccccattctgcttgttcatggagtcagcactcaactgcatgtcggaataagcaaatgttgtatagctcaaaccaaatccgaatggatataaaggatcgttcgatacatcaatataattgctgcggaacttttcaaaccatttgcctttagccaacggacgacctgtgttcttatggttgtaattcataggcaactgacccacgttctgcggaaagcttgctgtaagttttccactcggacaaacatcgccaaacaaaacatcgcatatcgcatcggccgactcacttccgccaaaccagacgttcaaaatagacggaacgtgctgctgttcccaagtcatgactgttggacggcccgcaaaatgaaccagcacaacaggcttacctgttttcaacaaagcatccagcaagtcacgctgtgcatccggcatttccaggtttgtacgactgctgcattcaccactcatttcagaagattctcccaatgcggctacaatgacatcagcctgtgaagcaacacgcaaggcttcgtccagtaattccttatcattgccacgaggaatttcccgaccgaacatggtagcacgagtctgataatccgcatcgtacatcaaattactgccttgtgcataaagtacattcgcctgattacccactgcttttttcaatccttcgagcaacgtactgtaacgttgcggagttgcagcaacactccatgtacctggcatattagtacgtgtatcagctaacggaccgattaatgcgatattaccttttttctgcaaaggcaacaaattattttcattcttcaacaatacgaacgattcggtagcgatacgacgtgcctcagcacggtgttctgcattataaatatctttagccggacgattcaggtcacaatatttatagggatccttaaataaacccagcttatactttgcctccagcatccggcgacaagctgtatcaatgtcctgcatgctgactttaccttctttcaaagatttttccaatgttccaataaagccatcagcaaccatatccatatcggttccagccttcagtgcacgcgcagatacttcctgcaaatctccgattccatgatccaccatttcagctattgccgtatagtcggtaacaacgaaaccatcaaatccccactgtttacgcaaaacatccgtcatcagccagcggttagcagtagcaggaactccatctacttcattaaacgaactcatgaagctaccagctcccgcctcagcagcagctttataaggaggaaaatactcattaaacatccggttacggctcatgtcgaccgtattatagtcacgtccggcctcgatggcaccatacaaggcaaagtgctttacacaggccattacctcatcgtttctttccatcttttctccctgatagcctttaaccattgccttggctatttcagctcccagataaggatcctctccattaccttccgaaacacgtccccaacgggcatcgcggcaaatatccaccatcgggctgaaagtccagcagataccatctgcactggcttcaatggcagcaatacgcgcagacttttcaatagcctccatatcccacgtacaagaaagagccaaaggtataggaaatacagtttcatatccatgaattacatccataccaaaaagcaatggaatacccaaacggcttttttcaacagccagctcctgcatttcacggatagctttcacccctttcaggttgaacaagcctcctacttctccccgactgattttcccagccacatcactactcttagcctgtcctgttgtaatattaccggtgacaggcaagtttaactgacccaacttttcctgaagagtcatcttgctcatcagttcagtcacgaacttatccatgttaccttcgtctttaggcaacagcgattttttatttccggcaaagagagtagccgacacacataaagaagtaaccaaaaggaatgttgtctttttcattatttctttcttattaagataaatcattttttaacttcaaaacctaaattcttgagtccagcctgaatttcaggacaactcataaacaagttccagagtaatccggtacgatagttttctatcattggagcaatcgtacactgatctatagccagatagtgaggtacagtccagttcgctgtttccgaaaaggcatcataaaaaccatacgtaccccagattgtatcaccctttgaataaaaatacttcaaagcacgcattgattcttccggagtatacggaaaactcgacaaagcagccgtaggagtaatcacccctaaatcattttcacccggacaatgtgccgcataaccattcacagaataactggcagtcagtccccagcaattttcaccatatcctttatagcccttcggattctctacacaataccggtaatcagacaatgcatggtttcgtaccacattccaataatcggcataacggtctttaattttacgtggatccaatccgatataggaataatgtgcccagaacaatggacctcccagttcctcggctccattatgtttcaactccagaggcaatccataaggagcagccgatgtcttgatatttcctcctcgtgcccatccattatgataagcagaagcaggaaccggatgcgttggtgaagatgctgccagcacataaacaattaaagcttcattgtagccttcaagagggaagttcatctcccaaccataattgggcgaccagtgccagtaaataacgtctttcccgttctgataccagtcgaattccatttcgtgccacaatttattaattttttcacaaagttccttctctctagaggtcccattttcaaaatactggcgaacacagagcaaactttgcatcacaaaacaactctctactaaatcgcctccatcatctttcaatccaaaaggctttactttaccggtaggtccgtcaagccagtgaggccataccccatgaaaacggtcggcacgcgtcaggtaatcaacgattttatgcaggcgttccacaccatcttcacgagaaacaaattttcggtcgatagcaaccagaataccggcaataccgaaaccactgcctcccgtagtgactaccgaagaatcattctggggataatttccatctagatgaatgcgttcaggagccagacctgaggtcttttccgctccatcccacatataattaaaatgtaccttttgtatataatccagcattgcactatccgaagggaaagattccggacgagtacttgtctggtcagtaatgcttaagttttctccttttttagccgatgtgcacgaaagcaagaacagtacacacaagccacaaaaatatttccacataagtatctacagattttatctgttatcaatcctttcaggagcctcacgtctacaacgctaagcccctgaaagttattttactaaaagcataagccattattcgtctttcggctcgttttccaatgttgaagatatatcaatctgggcggtaggaaccggatagtattcttttccggcagtccatcccaaaggacctaatacttcgctcaacttacctgtacggcgcaggtcattgtatcgttcaccccattccaatgcaagttccatacgacgttcatccataatctgatcgattgtcacatcctccaactcaggcattgctgcacgtttacgaaccagattaaatggaacgtcaccattcttttcttgacgtacctttgcttcagcattcatcaaaagcacttctgcatagcggaatacacggatattgttatttgttccatattccgtacgtccatcggtcatctggttagacggagtataagcctttccgttaaagcaatccggagctacgctgctagccggtgccttgatgaaatcaccttcttgagtcgtttcacctgccatcaggaaggttgtagtagcacgaacggtttcaccacgttcggccgcccactgacggaaagctttcgtcggactgataaagccccatccggaaatattaccatcattcaaagggccctggaatacaaaccagctgtccggaacgacaacttctcccgaaccgttgccaaaatcagtaaactgcatttcgaacaaagattcatcacagagtttacctggaattttaaacaagttattaaagtcatcgtataaagagaactttttacttccgataatatcatctgtcagttcctcaactttcgaccagttctcctgttccatataaactttggcagccagcatctcagccgtaaaggcagaagcagcacctatacgatctgtatattcgttcggacggatacgaggcaaatgtgttatagaataatccaaatcgcttaacatatagcgatatacagcatttaccgtagaacgagtcatatcggtctgcttattgtcacgcaaaatggtaacaggaccaaacaattctgtcagacgatagtagcaataggcacggataaattttacttcgcctgtatattcttcataacgtttttcatctgtatccgaaacgatgttggcagcataaccatcaagagcctccagtgctgcattggctaccttaatgatgtcataataaaccatccatgcctcgtttgttccccagaacccggcattataagtataattctgatcgatagcaaccaaatctgcctggtcgtcaattcgacctgtagaaacatcatcgtcacgaacaaccgtagctccccatacaatccagtgagaacctctctggcgtaactttgcatagacaccagataccggctgatacatattattcaggtttgtataatcaaccttttcttcgtcgaccttattctccggcaacttgtccagataatcggagcaggaagagaataatgttgtggcagcaaacgcacacagtaatatattttttatcttaagacttttcataaatcagcgtgtttaacaatttgttagaaatcgatagtcaagccaaaagtatatgtggcagccagtgggtaaacaccctcgtcccaaccatagctctggctaatttcaggagtaaatccgttcgaagtaaagtaagtaaacggacggtcagcagtcaaacttacctttacacccggcaatgtataacttcccatgcggatattgcggaaattatatgccagcatgatattctgtatacggaagaaattacctttttcaacaaagaaggagttggtatgactgttattccaagccttcagcataccttttgccgaaggatatgaattggtagaaccttcacccgtccaacggttatcatagaaatccttatcgaagttgaagtttgcctgagtataacgtacggcacgcttacggttataaatttcatttccggcttgtccgaatgttgacaaagagaattccagattcttatattggaaacctaaattgaaactataagtcagggtcggtatattcgatcctaaaatctgacggtctttatcatcaatcacctggtcgttgttcacatcttcataaatgaaatctccaggttccagtccattagccttagctatcggatcaacatcaatctgagcctgattctgatatactcccaacactttatatccgtaatacgactgcatttcttcgcctaccagattgatggtacggctttcagcactaccaccataaatataaggagcaccattcagactttttacacggttacgcaaagtagacaggttcattccggcataataactgaagtctttaccgattttgtcactccagttcaactggatatcaaaaccactgtttcgtatttctccattattacctgccaaagtctgtgtactgaaaggcaaggtagtactgataacagcatttttagtgatacggttatagtaatccacatccacgttcaaacggctgtctaacagagcaaagtttacaccagcgttaaactcttccaccttttcccagcctaaccagctgaaataacttgtattctggaatccaggcaatgtcgtattaccgaatacacccgaagcagaagtcccggtagtaatagaagcaaatccgtcactggctgaaacatggtcattacccagctgtccccagcttgcacgaaccttcaaataatcaattgcatgctgtttcttaaagaagttttcatcactcattacccatgcagctccaacagaagggaaatacccccacttattctgatacttggaactaccatcggcacgcattgtcaaagacaacaaatactttccggcataatcataacttgcacgagcaaaataagataatccacgatagcaagaaccgtcatcgcttacttcacgtccggtagagttaccttgagtaaggtataaatactcatcataatctccgggaacattgcttgcctttccttccagcttacgcatctgctcctgacgtgcagactgtcccagcaagacattcaggttatgactaccccacgagtctgtataagtcaatgtattatcccaaatgtaattataatagtttgtgtctgtcttggtcaatcttgattcagaattctgctgcaatgaacttaccagataaggctgaacatacacacgtcctcttatcaaagagaagtcctgactatagctggtcttaaactttaacttattaggaattaagttcaactcagcgaaaaagttagccattacctggaaggtttcattcaagctattgttattgtatttggcaatagccaccggattcgagaagttattagtaagccctatttgctgaggagaagcaaacttttcagggaaagcctcatcgtccgaacgagtataatcatacacaggcatcaaggaaggcatgttgtaagcagccagccaagctgagttttcaggattatactgttctgaattactgattacaatgttacttccaaccttcaaccagtcggttgcttcaaaatcaaagttcgcacggaagttcaaacgattgtaattattgcgcgtatccatgataccattctgatacagatagttgatacctactgcataagttgctttctcactaccgccactgatatcgactccatgattagtcatcaaggcaggacgcaacaattcgtcataccagtcggtatcggctccaaatgtcaacgaatcataatcgcctccaaacttttcgatagatgcttttaccaacggctcgtaagcttcacggttggcttccagcagcaaagtagcgtactcatgtgaattagccatatcaagcacattggtcgcagtctgtacgcctacataaccattatatgtaattcgcgctttcgtattacgtttacctttcttggtagtaataatcacgactccatttgccgcacgcacaccatagatagcagcagccgacgcatctttcaatacagagatttcctgaatatcggaattattcaaaaagttaatgttatcgtagaacatgccgtctactacataaagcggagaagtgtcgccaaatgatcctaaaccacgaatggtaaccttaggtccgcttcccggagtacctgatgaaacgacattcatgccaggaacctttccctgcaaagccgacatcggagaagtagtagcctgagaagcaatctggtcactctttacaacagaaataggagctgtcaaatctttcgctttactggtaccataaccaataacaacgacatcttccagtttttgtacatcgtccgagagttcgacattgatggttttctttccatcaatttttacctcaacggttttcataccaataaagctgaacaccaaagttccatctgccggaacattttcgagaagatacttaccatctatatcacagatggtaccgagcgttgtgcctttcactaaaatattagcaccaattacaggttctttaaagttagcgtctgttacgacaccttgaaccgttactgtccgctgtgcataagctgtagcgacgaacagtaatgacatcagaatgaatactaattgttttttcatgaattgattaaagttatgattcaaaaacggggcaaaggtgtatataaacttaacaacccacaaaaaaagtgatacgacgttactacttcgagcgcattcagcactacttttttactactttttcaactatatttttattcattatcagtaaattagcacatcacttcaattcgataagaaaatcgacaagactcacgccgtcgggaacttccattcgctttctgatgcgataccgcgctgcctctacgccccgaattgtcagattcatcatctgtgcaatatccttagtggaaagattcaagcgaagaaaggcacaaaagcgtaaatcggttgccgtcagattaggataacgctcacgcaatgtacggaaaaagcgctgatgaatcaggtcgaagttctgttgaaaaacttcccaagaatcctcttccgcaatattttcgtttatctgtttcaagaccaattccatatttttacgcccgcattgcgatttagccagctgttcctggacgacagaacgtaatttttccagcatttcctgcttggcaaacgttcccaatgccatgctggccaattcttttccttttaaaaccagttctgcctccagcagttgtttctgctgctcggtaatcagacgttgctgctcactcagtttaatattctgctctatcttatgcgcttcatattcttttctttttttctctgcaactgtttttcctctccatcgagccactccataaaccagtccggccagcaacaacacatacagcaacagcatcggataagacatccacaaaggtttactgatgacaaactcatattttgtttcatccagcaaccgtccatcatcactatacactccggcccataaagtatacgaaccaaattcaagacttccaaaatgaacagatgggaatgtactttcttccgataattgctgacgaccggattgaagcttgaacttaaaacgaatggctggctggtcataacacggataagaaagcaaaactgaaatatcacgatagtcacttgctacaacaacttctcgtgacacatccagagcaagctcctctcctgaagaagaagaggcaacaatcctccgtatcttcaaccccgacaagctgcgatgccctatatattgctcatccagctgcagacaggctatactattattcagattcaagtagcaattatttccgtctacataaatcttgttattcccttccacgcaaggagaattaaacgtttcgaccggaatacgacgcttgatcacaaactttccgtcgtgataggccaacagtacatattcgtgtgaatttatcagccagagcatttcgttattgtgtacatccaccgccgtatgcgcatccatcagaaaaggcacagcaacattcaactgctggtaaggcttaattttacgttcaatatcgtcatacataaaatatccttcggcactggagaaaacaatacgccctctgattttcataacatgtatcttacccgatgtcttctttcctccaagcgtatgaatatgttctatctcctttatacgatataaatcatcgtccagcttgatgcgataaagcccgttatacatgtgcgaagcccagatcactcctgttccgtctacctccagcgatttgatgggcgcataaaagtcctttacgctatgcgacagataccagataccgtctttctttttccatatacgcaattccgcatacgaagcctccaccagcacatcctgcccgttgatggaagcctttacgatacaagtactgttcaaagttcccggaacagcctgtatgataccgtttttaccgatgagcatagtagaagcatcattcccgataaatatctgcgaatcaatttgctttacataccagttttgccctgccgtgtggggtaacaaccggatttcacttgtatgctgattatattcataggccccctgattggttgccagataaattttctcacctattctttccaccccatacaccatacctatgctcaagtcctttactgaaggagtaagcagcgtaaccgatgtattggtatggataaaagagattccatcgtccagagcagcccataaattgttttcattatcgcaaaacagccccataacggaattgttatttagttggttgtcacgactgagatgccagagcagacacccgcttttattcaatccataaataccatccaggatagtaccgactaccagaatagaatctcctaccataacggcacggttaccctttgcccagcttagttgtttgtcgatatctgtatgcaaagccgaaactgttccattccgataggtaaacaggccatggtctacggtaagcaataccataccatcttttccgtccggcaagaccgatacaacattatcatcgcctaccgccttccggtccaatagagaatgaaaccggttcccgtcgaattcatagaaaccaccgtcaatcatctgagcatagatgcgttgatggcaagcataaaaatacaatggacggaaatcggcttcacgactcatgcaagtgacctccttcccatcgaaagcataccagcgggtaaacgactggaaataaattttcccttccaaccgtacaatgtgccatatctcatcattgggagcaacctgattcttcacctttgcactcaaagagtgatattccattcctcccgttacattgcgagtaaaataaccgaactcttcgaatgaaccgatatagattttatctttgtcgacaaataccgaacggacaatatatcctcccggtactttatgaagttcccacgagaagccatcgtacacaagcagtccgttgttgtttccaaaatacatcaccccatcatccccttgcgcacatgcccaattctgatgagctccctggtaatcttttaccgtataatttgtaatggcagggataaaatcagctccccaagccggaactgtacataagaataaaacaacctgaaatattttcaagagtatcagtttcattggaattttcataaaattatacacaaagatacacgattttctgccaaatccggttacatccggctgatagatttgcaggcaaagcaaaagtcatccatagccatttttgctacagatgacttcctcgataaaaatttatcccaatcttcttacctctacttgcaatgtataatctccgagcgctgggctactccattctcattaaacgcctcgacacagaagtagtaatcctgcgtggttgtcagcgaacgcatgaaaagttcattggcatcatacaccatccacgaactgtacaacttgtcgggagcgattccccataatacgttatatccttgtgcaccctgaacaggtttccaactgatggccacatctctacgatctgtctggcggaccaacttcagtccttctaccttccggggaactttccccgttcctttcccgaatagacgtaactcggatatagccagatgaggtgtaggaacatgtacattacggtaacgcacatatctgactttaccggggtgagccagttctacatagtcatttggagtatccttataactccgacggcgatctaccagcacttgccatgtctttccgtccaatgaaccttccacataataacgatgatacaagccatcataacgtccatacatattactctgataatcatggtagtttatctgtacggcacagacttcagcttctttctgtaagtcaatcatcacccactgcttgtcatcattggcctcagcaagccagaaagactttgtctgttcgtcagtcaggccttcaggaccatactccccaacctgcgatgatgctgtaaccggcttcttataagagagcaacatccatccgcggaactctccttttttccccggaacagccggagcataatgaggataatctccaaaacgagtatcacaaaacataatgccatccttgtcgaatcccatcgggaacatacaaagtctacgctcccagttcacattgatagacaatgacatggacgcaaaatgccagtatgtactatccggacctaatacactgcttccatggccggcaccgttcatgaagcctcccggcttataagatacaggattatgcttctggtaagtataaggccccatcggattatctgccacatataccccgtcgccataaacattgaattcggttccgggagaggcatattgcatatagtacttcccgttgtgcttagtcagccagggaccttcaataaatccgcctaaatcagaatcacttacatgattctctccaaatctttcccagccatgctgttccagatcaagtccgaaaagttcttttttctctcccttcggaagaaaacgatgattacggtccagttctatgccccggatgggatatacattcgacgatccccagaacatatacgcctttccatcgtcgtcgatgaacaaatccggatcctgcaaatcgtgcaaaatagcaggaacgcccttccagtcaccttttttcggattgtcggtataaagaacactcatcgaacccgacgggtcgccacacacataaagcagcgaatctttatagttatgtgcagcaggagcattgcatccctgaggataccagttggacggaaccggaatgaaatcccagttctgcaagtccgtcgaatgccagtaaccatgcgaacgggttacaaacatataatattcaccacgaaattcaactacagcaggatcagctcccgaacggtatgaaatatccttgtccgaattataaatcatataagtataatctatattcaacggattgcagaaagtttccatacgggtactttgagctttaagcggtgcagccaatactacacaagacagaggtaacaaaaaggtttttagtttcatagtcatttaaattatgaagccaaatgtaggaacttttccaagtgttccgattattggccgctactacaagaatacgtttctataatatccggactaccgttttgctacgttttagataaataactatttgtatacgaacatcttatactattaaatcacccttcactattttctttacttcctaccttttcacacctgcacggactgcctgtttattgtaattccatcaacatttaccttatgtttataggtacgacaggaatctccgtgacacataatccgcgcagtccgtcccaccggaaagttcgcccggccgggaacagcccccacaagacatcagccatactacggacattgcttcttaattacctcttcatgccgcttttagtctgtgggttagtcctgtctatcatcataaatgagatgaaaatatcgtccatttacagatgcagtaattattaagttttaggacaattgttgcatttttattgcgcggtttttctgaaaaatcgtaactttgcgacatatattcggatatatgtgtatgaaagatacgaaacagcaatttgaacatgtaatagcaatctgtcgggatttgtttgccaaaaagttgcacgattatggtgctgcatggcgcatcatgcgtccttcatcggttaccgaccagatatttatcaaagccaaccgcatccggagtattgaaataaaaggtgttgccctggtcaacgaaggcatacgcccggagtttattgctatcgtaaactacggcatcatcggattgattcaactggaactgggatatgccgagaccgacgacatgaccgaacagcaggcactcgacttgtacgacaaatatgccaaagctgcgctggaactgatgctggcaaagaaccatgattacgacgaggcatggagaagcatgcgtatcacctcgtacaccgacctgattttgatgaagatctaccgtaccaagcaaatagaagcgctgagcggcaatactttggtatctgaaggcatagatgccaactacatggacatgatcaattattcggtatttgctttaattaaactggaatttggagaataaaaatttacatagagctattttcgtatgggtaagcatctgtcgttttctgctggcaggtgtttttatcttttccggatttataaaagccaatgacccgtacggaacagcatacaagatacaagactacctggaagcctggggactctcacaaatgttgcccgatgtgtttccttatctgggtgcgatggtcatgggtgtattcgagtttgcccttggattttatatgctgtttggtatacaccgcaggatagcccctaccctgatgctcattgtgatgtctttcatgactcccctgacactgtggcttgccatctccaatccgatttctgactgcggatgcttcggcgatgccgtagtactgaccaactggcagacctttggaaaaaacattgtattgctcattgcagccattaccgtattcaaatggagaaagacaggcatagtcaaactcgtcagcgagaaagtggactggctggtagctctttatggagttgtattcattattctctatactttatactgtatacgggaacttccggtattcgacttccgtccttaccacatcggggcagatatacgtaaaggcatggagatacccgaaggggaaaaacccacaacctacgaaacgactttcatctatgccaaaaatggagtagaaaaggaatttaccatcgataatttcccttccgactctacatggacgttcgtcgattctaaaacccgtatcaaagaaaaagggtatgagccgcctattcacgatttctccatcatctcgcaagaagacggaacagacctgacagatacagtactagacgacgaaaattatacgttcctgctggtagctccttatctgaaaaaggcagacgacagcggcattgacctgataaacgaagtatatgactacagtgtagaacacggataccgcttcctctgcctgacagcttcgccagatgaggacattgctatctggcaagacaacacaggtgccgaatatccgtttgccctgacagacgaaattaccctgaaaacaattatccgttccaatccggggctggtactgctgaagaaaggagtcgtcatcaacaaatggagcaacaaccaactgccagacgaatatgagctgaatgctccgctggacaaactttccatcggaacactgaaccagaaaaccgtcagccataaactggcagaagtactgggatggtttgccggtccgttgctgttccttaccctatgcgatctggcatggctgaaatggcataaacggaaaaagaaaaaagaagaagaacaaacagaaaactaaatagtatacaaaccctttaaattttaaacaaaatgagaaaaaacattgtagcaggtaactggaaaatgaacaagaacctgcaagaaggtatcgctttggctaaagaattgaacgaagtattgacagcagataaacctcactgcgacgttatcatctgtactccgtttattcacctggcttctgtaactccgatcgttgacaaaaacattatcggtgtaggtgcagaaaactgcgcagacaaagcatctggtgcttatacaggtgaagtttcagcagaaatggttgcttcaactggtgctcagtacgttatcctgggtcactcagaacgtcgtgcttactaccacgaaactgttgaaatcctggcagaaaaagttaaattggctttggctaacaacctgaaacctatcttctgtatcggtgaagttctggaagaacgtgaagctaacaaacagaacgaagttgtagaagctcagctggcttctgtattctctctgtcagcagaagacttcagcaagatcatcctggcttacgaaccggtatgggctatcggtacaggtaagactgctactcctgctcaagctcaggaaatccacgctcacatccgttctttggttgctgctaaatacggcaaggaagttgctgaaaacacttctatcctgtacggtggtagctgcaagccgaccaacgcaaaagaactgtttgctaatcctgacgtagatggtggtttgattggtggagctgctttgaaagctgccgacttcaaaggtatcatcgatgcttttaaataattaagcgaactatatcatttttcacggaagaaggagttgttctttctcctcttccgtgattattcaaactcattttttcacatatccggtatgatgaagtatttattcacccttttattcctgcttacggcaagtatggcaagcgcacagcggaccatcatagaaagcctgcaaacccaacgtccgggagaaggtattgtcaatatacatcaggacgcttacgttgcttcactaataggattacgctatgtaaacaatgccgcaacttccaacaagacactgaaagcaagaggttttcgtgttcaggtatatgcaggaaacaattcgagagtggcacggaacgaagcaacagccgttgccaataaagtgaaacaagaatttcccgatatgccggtatatacttatttccaacctccccgctggctgtgccgtataggcgatttcaaaagcatagaagaagcacacgtagctatgcgcaagctgaaagagagcggcgaatttaaagaagtggcaatcgtacgcgaacaaattaatatacccattgaataatgattgatacgaacttgatgcactttccggaagagaaagtgcagaaactgatgtcgcactacaaggaaatactttccctgctgggagaagaccccgaacgtgaaggtttgctgaaaactccggaacgtgtggcaaaggccatgctgacactgacacgtggctacgaagtagaccctaaagaagtactgctgggggctaagtttaaggaagaatacagccagatggttatcgtaaaggatattgatttcttttccatgtgcgaacaccacatgctgcctttctatggcaaagcgcatgtagcttatatccctaacggctatattaccggattgagcaagatagcacgggtggtcgatatattttcacaccgccttcaggtgcaggaacgcatgacgctccaaatcaaggaatgcatacaggaaacgctgaatccattaggagtaatggtcgttgtagaagccaagcacatgtgtatgcagatgagaggagtggaaaaacagaactccgtaactaccacctccgattttaccggagccttcaaccgagcaaagactcgtgaagaatttatgaacctgattcgcaggtaaaactatccagaaatccggtactagaaaatgatttaagtcaagtctccgcgtgtaaaaaagtcgtaactttgcacgcggattttttttatcatctagtggaacaggcaattcaacagactaacattcggaaaggattaaccaaactggttattcctatttttatagaaacgttattgattatgatgctgggcgcagtggataccatcatgctgagccagtattcggacgaaagtgtggctgccgtaggtgtagtcaatcagatagtcatgtttgctttcctcgtattcgaagtcatcaacatcggaacttccgtgctctgctcgcaatacctcggagcaaaaatgcataagaacatggtacaggtggtaggagtcgccttgctcctgaacctcgtagtaggacttgttatcagtgcaattcttcatttcggggctactacattgttaggatggatggggcttcgtcctgaattgttgaaatacggtatcggatatatggagattgtaggtgcctttgctttctttcaggctatatcactgactatatccgcttcattgcgtagtgccaacaaggccatttaccccatgctggtcaccgtactggtgaatatcatgaacattatcggaaactactcgttgattttcggtaagttcggcatgcctgccatgggagccgaaggtgctgccatatctacttccatagcacgaggagtaagcatgatcgtgctgttcgtcatcttgttccgcaagcatattccgaaattcccgctggcttatttccgtcccttcccctggattgagttgaaaaacctgttgaaagtgggactcccctctgccggcgaaaatctctcgtacagtttctctcaggtagtcatcacttacttcatcaatatcctgggaaacaacgcactggcaacacgtacctattctgtgaacatcgtcatgtttgtatacctgttcgccatcgccatggcacaaggaggcgccatcagtatcggacacctggtagggcaaaagaaaatacgtgcagcctatctgttagggaaatatgtcatgcgactgtccatcctggtatcacttgtcctttcgtgtatctgggcagcaggcggacacttcattttcagccttctgacagacaatcaggagataatccgtatgggagtcactatcatgatcatcgatgtagtggtggaaataggacgtgccgtaaacatctacgccaccaatgcactccgttcggcaggcgacgtaaactatccgttctatgtgggacttatcgtacaatggagcgtttcggtaggtttcagctatcttttaggaatccactggggatggggacttcccggtatgtggtgtgctttcctgctggatgagaacatacgcgccatcatattcgtcaagcgctggaacagcctgaaatgggcaaagaaaggatttgtaaagtaattacatatttcctattcccacgtaaaaccagagaatgcagatcaggtcgatgacaagcgctgtcaccgaccattttacaaactgcttatctttcttcacggccccgtagatgattccgatgacggcagaaattaatatgcctgccgctactccaaagataccttgtacggcaagccctacaaggatcagaatagccatggtgaccagaatattgtttttcataagtaccgtattaaaatgtaaaacccgattacatactagccttaaaagccttaatcaccgccgaagtaaatccatcgtgttccaatgaattgactcccttaatggtaacacctcccggagtcgtaactttctctatctcgattgccggatgcgagttttcatcgctcaacaacaaacgggctgcaccgtccagtgtctgtgccaccatcttcttggcttctcccggacgaagaccggcttctaccccagcctgcatggcagcctgtacatatttcattacataggctatgccacacgaagcgagtgacgtggcagcagcaaactgtttttcttcgataagcatggcaagtcccatttcattaaagacgttcaacactttctgtgtctgctcgtcagttgcatttctacaggcaatcagcgtcatgctagcacctttggcaatggccgtattcggaatcacacggaaaatagtcatttccggatcaacaaaatgtgccagattctcgaacgtcagtccggctgctaccgaaatcagtatctgtggctggcgaagacgcaacggcttaagtacttcttctaccttccacggcttgacagctacaacaacaacatctgcatcggccgcatctttgttgttggtcgaggtatgaatatcgggaaactcagccttcaacttatccagttttgccgtactaggattggtaactattatttcacttgccttgacataatgtccttgtgccagcccacgcgcaatagctccgcccatgttgccggctcctataattgctactttcatattacaccttaatcgttttattactatcttatttcaatggctgtgacagctcttccagcgactttccttcatagtcacacacagcctgcttgaagtcggcaggaagttccacgggttcctttgttgctacatcgtagcccaccatgaccgtacgacactgacacttcaacacaccgctcgccttgttgatagcccgctgaagcaaggtaaagctcttatgtcccagatgtatgacagtagtttctattatcagatcatcggaaaagaacaccggagccagaaaatctgcatttatattggctacgacaatacccatatgatgccagtccttattgccgaacacatcacgcatatacgaggtctttgccaaatcgtatagagagaaatacgaagaattattcatgtgaccatactgatcgacatcgttgaagcgaatctgtacaggcaacgtatgcctgaatttcatatcatctgccatatccatttgtttttatataatctcaaatataaatcttttttcccaaaaacctacaataaaggaagattatttcttatttttgcccgtcgacaaaatgaaaaagtcaatttaagcattacaatatggaacagaaattcaaaaaggagaccttgtgcgtacaggccggatggactcccaagaacggggaaccccgtgttttacctatttaccaaagtacaacattcaaatatgataccagcgaagaaatggccaaactcttcgacctggaaaagagcggatatttctacacccgtttgcagaatccgacaaacgatgccgtagcagccaagattgccgcactggaaggcggtgtaggtgccatgctgacttcatcgggtcaggctgccaacttttacgctgtattcaatatctgtgaggcaggtgatcactttgtctgctcatcgacaatttacggcggtacattcaacctctttggcgttacgatgaaaaagctgggtatcgagtgtacgtttgtcgatgccgacgctcctgaagaagaaatcgaaaaggctttccgcccgaataccaaatgtctgttcggcgaaaccatctcgaacccgagcatcaatgtactcgacatcgaaaagtttgcacgcatcgcgcacaaacacggagtgcccttgattgtagataatacatttgctactcctatcaactgccgcccgtttgaatggggagccgacatcgtaacacattctaccaccaaatatatggacggacatgcaacttgtgtaggtggtgccatagtggacagcggcaacttcgactgggaagcacatgccgacaaattcccgggactgactcagccggatgcttcttaccacggactgacttataccaaggctttcggcaagatggcttatatgaccaaagcaaccgcacagctgatgcgtgaccttggttccatacagtcgcccgaaaatgccttcctgctgaatctgggactggaaacattgcacctgcgtgtagcacgtcactgtgagaacgcacagaaggtggccgaatggctggaagcaaacccgaaggtaaaatgggtaaactactgtggactgaagagcagcaaatattatgaactggctcagaaatatatgccgaacggctcttgcggtgtcattgccttcggactgaaaggtacccgcgaagatgccatcaaatttatggatcagctgaagctggcttgcatcgttacgcacgttgccgacgcacgtacctgcgtactgcatccggcaagtcatacacaccgccagctgaccgatgagcagctgattgaagcaggtgtagctcccgacttgatccgtctgtcggtaggtatcgaaaatgtagacgatatcattgccgatctgaatcaggctatgcagtacatctgatcaagctcctgtagccactaacaggcgatacaataaaagatctccccgacaagctacaggaataactagaatatctaaaaggatcgtatcaaggctctattgtgagaattgatacgattcttttttgtttccaacccataggcggaaactggagaaaacgtcgagacgtttttatgaaatttgtacaaattctgaaatgttttgtacaaaaacaaaagacaatctcttctttatcctttctttccagcacatccttaaaaacaactttccaggcaaaatcatcgccaggcttttcaggatttccagaacgaaaagttgcgagataaacttccttttactacattcgcccgtaaatcatttattttcattgcttatgacaactcccaaagactggtatactttgcgaataaccgaaacgacaaaggaactaactcacataaaaaaacgtattctgcacatcagcttgttgcgtattgcctttttcctggctggaatagcaggcattattctgttctttcatgccggaacctgggctctgatcggcacagtatgctgcacctttctcccttttctgatcctgatcaaactacataaccggttcttcgcacgaaaggaatggctggaaactcaggcacaaattaaccgtgaggagctgaaggggctggatggggatttctccgacttcgatgaaggcaaagaatttgccaatccggaacatccttattcattcgaccttgatttgttcggccgacgttcgctttttcaagccatgaaccgcacttgtacgcacatcgggaaacaaacgcttgcacgatggatgcaggagcatctgacaaaaaaggaaggaatagaactccgccagcaggcagtaaaggatatgagtgcaagaaatgaatttcgggaacagtttcgggttacgggactggtcaaccacggaaagacatccgacgaagaggaaatacgccagtggagtgaaagttcctccgagctgctgcatgctacgtgggtaaaactttcgttacggggagttccgcttgtcaatgtattgttactcgtaggcgggctgaccggtatttgttcgctgaactggttcgggctgatgttcatgctgttcatcatcaccagctttgccatcgtaaaaaaagcgaccttggtacaacagacgtatggcgaaaaactgaaaaccttgaacagttatgctaagttgattgcgcttactcaccagcagacatgggaagcttccgaattgcaacaactgatgaatcggttgaatattgacggtcattcgcccgctgaagctttgatgcaactatccaaagaactcgaccgtctggacctgcggaacaaccagttgctttatgtcgtgctggaaggaagtatcttcttccaactgcgacagatagtccgtatcgaacggtggaaagaacgttacggacatcatctgatgaaatggctggaagctgtgggcgaactggatgcgctttgttcactgggaacctttgcttacaaccatccggattacacttatccttccatctcagaccagccttttcagttcattgcacgtgctatgggacatcctctgatgcctgccgaacaatgtatcaagaacgatgcaacaatcccgtcacggcccttctttttgattattacaggggcaaacatggcgggcaaaagtacgtatctgagaacgattggggtcaactatctgctggcttgtatcggctgtccggtttgctgcgaacaactcacactgtatccggcgcaactgatcaccagtctgcgcacctccgactcacttacggataatgaatcgtatttctttgctgagctcaagcggctgaaacatatcatcgatttactgaatgagggaaaagagctgttcatcattctggacgagatattgaaaggtaccaactcgtccgacaaacagaaaggttcgctcgacctgatccggcagttcatgcacctaaagaccaatggaattattgcaacgcacgatttgctcttaggtacactggctgatcaattccccggccaaatccgcaattattgtttcgaagcagatattaaagataatgaactgagcttctcttacaagctacgggagggagtagcacaaaacatgaatgcctgctttctgatgaaaaaaatgggaattactatacaagaggaatgaaatctgtttgtgaagggcgtgaagggcaaaaacaggtgatttttttctatacaaggctcgagaacatactcatgcacagcttcagcaaaaaggttcataaaagtataccgcaaatgactacttactccaactgaagataccacaaagtacaagtattctgtagccgtattatctgaccggtacaaccaggccaatgaatagctgcaacgtaaaacaatatacattcatagggatattcagtaaatgtccccaaaataagatggcatatgaaatgattatggtctatcatcttcatatgccattttttattgtcatttttccatgtattctcacataattctatccgtcaggacatgacacttctgaagaagccagatgacctcttccgattccgtcagtaaaatcatatcatgccgctttaaccgtcctgttcctgatcttgtcaatcatcagtacggcatttgccgtatgtattccgaagaaaatccataggatttccgtcctcctgttccgtgcctttaccctggagagcgagtaatgctgcttctgtgtgccgaaactgccttcaagccgggtgcccctttctttggagagttcacttctgagaaccttcctcaaggattcatccctggccgcccttcccttgcgtacgaaggacgtggagattccgtatttcgtgcagaacttcctgttggcgttattggcatatatggaatcggctgccacgcatcttacccttacgttcatgagtttctgctgcatgcgaatgcagtccttcaggcgtatcccctcgttgaaagccttgaacgagaggtgttcgatgaacgatatgccgtctatctgtatgttgtttaccttcgcaccgaactcgacggatttcgtttccttacctcttacgatgggacgtacataatgacggtcaatgctgacgatgcggtcactgacttttcgtccttcaaacatttgcttttcctgtacaagaacctttctgatgatggaaagccgcttccggtaatcctgagtataccggagtgaggctccatgctccctatgaattccatcccgctgcatgaggagtttttcaaggagtctaatcatacgacgcttgagcatccttgtccttgatgcctttctctttcttttcttacagtaggacagataagccttggcaacatcatcatatttgttgcggggacgtcttatgccaagttccccgcaatgcttgcagatatgcctgtagagccattcgaggctttcccaaaggagcttcatgtctgtcgggaaacgcatgtggctttcatagcatgtagcatcggtcatgcacacgtgaaggttctcaagataaggtttccagtgtgaggccagcacttcctggagggattcaatgtcaagacgggatgccatctcattgcggatggcactgactatcttgtagttggttatggggaaggacgggtctatcatgattccgcagaacatctgatagtgtatgttgccgttcagatgttccaccagctgtctgtcggagaatccggtgtatgccttcaggaccatgagggcaatctttgccgcagggctgaagatgttcctgcgtcccagtcgctgttccaacaggcccaaggcttttgccatacgctcaaacggaaacaccgagtgaagcctgccaagctcactctcgttaaaactcttgcggtatttttccagaatatcaaattctgtaaagcccaaagcaggctgaatttctgaaatattttgtacttttgccatatcttggttggggaatttcccccgttttggctgccaaaccttatttgcgggggaatacctaaagatacaaaaaagccagctaattcgcaacactttgtgtatgaattagttggctaattttatattatttactgaatgtcccttcataaaaaaagccggagtccttttgggacctcggcttttaatatatatagcgtttacagaattattcagctttaggggcttcctctgtagtagcttctgcagttgcttcagcagcaggtgcttcagttgcagcagattttttagaacgacgagtacgagtagctttcttagcagctgtcttagccatgttctcattgtagtcaaccaattcgatgaaacacatttctgcgttatcacccaaacggttaccagtcttgataatacgagtgtaaccacccggacgatctgcaacctttacagagatttctttgaacagttcagttacagcgaacttatcttgcaagttgctaaatacaacacgacgagaatttgtagtgtcttctttagactttgtaatcagaggctcaacgaactttttcaaagctttagccttcgcaacagtcgtagtgattcttttgtgcttgatcaaagaacatgccatgtttgacaacattgcatttctgtgagaagcagtacgacctaaatggttgaatttcttattatgtctcattttttattctttatctaatttatacttagaaatatctgttccaaacgacagattcagactctcgagcaaatcatcaagctcagtgagcgatttcttaccgaagttacggaacttcaacaggtctgtcttgttgaactgtaccaagtctcccaatgtttcaacatcggcagctttcaagcagttcaatgcacgaactgacaagtccatatcaaccaatttggtcttcaacagctgacgcatgtgcaatacttcttcatcgaattcttcgttgccgtctgaatctgaagtttcaagagtgatcttttcatcagagaacaacatgaagtgataaatcaatattttagcagcctctttcagcgcttccttcgggtgaatggaaccatccgtagtaatctccagaaccaacttttcgtagtcggtcttctgttctacacgatagttttctaccgcatatttgacattacggatcggagtgtaaatagagtcgataggaattacattcacatcggtgcagaattcacggttttcgtcagccggaacataaccgcgacctttgttgattgtaagatctatctgcatagttgcttttgaatctaaatggcaaataactaattcaggatttaacacttcaaatccggtcaaatacttaccaatatcacctgccttaaattcagtagaattctcaacggtaatgcttaccttttcattttcgaattcctcaactatttgcttgaatctaacttgcttcagattcaagataatgttagtgacatcttcctttactcccggaacagttgcaaactcgtgttcaacaccttcaatatgaattgtgttgatagcataaccttccaatgaagagagaagaatacggcgtaaagcattacctacggtaataccgaaaccgggttcaagcggacggaattcgaattttccgaatttggaatccgcttccaacattaatactttatcaggtttttgaaatgctaatatcgccatgaaattaattattatttagagtacaattcaacgattaagtgttcttttatgttttcaggaatgtctgctctttcaggcttgtgcaacaacttaccagtcttagagttttcatcccattccaaccaaggatatttgctgtgattgaatccagccaaagagttagcaataacttccaaagacttagatttttcacgaacacctacaagctgtccaggttttacagagaatgaaggaatattaactaccttaccatctactgtaatgtgcttgtgaccaaccaactgacgagcagctgcacgagtaggagcaatacccaaacggaacacaacgttatcaagacgacattcaaggctctgcaacaagatttcaccggtaataccgttcatacttgcagccttttcaaacatgttacggaactgtttttccaaaactccgtaagtatattttgctttctgcttttcagccagcatgacaccgtattctgatgtttttctacggcgagtgttaccatgctgtccaggaggatagtttttcttagacaaaactttatctgctccaaagattgcttcaccgaatttacgtgcaattctagtttttggtccagtatatctagccattttcttacttttaaatttaattgttattaatgaacttaatttgttgcagccgcgattacagaaaggaattgcaatccattatttaacaaaatcaagttacatctaaataggttatctttattatactcttcttctcttaggaggacgacaaccgttgtgaggcaatggagttacgtcgataatttcagtaacttcaattccagctccgtgtacagttctgatagcagactcacgtccgtttccaggacccttaacgtaagcttttacctttctcaggccaagatcgtacgctactttagcgcaatcctgggcagccatctgtgctgcataaggagtgttcttcttagaacctctaaatcccatcttacctgctgaagaccatgaaataatctggccctcgctgtttgccaaagaaacgataatgttgttgaatgatgaatgtacatgcaactgtccattagcatcaactttcacatttctttttttagctgcgactgttttttttgccatattaacaattattatttagtagcttttttcttatttgcaacagttttctttcttcccttacgtgtacgagcattattctttgtgctctgacctcttacgggcagacctaaacggtgacgaacaccacgatagcaaccaatatccattaatcgcttaatgttcaactggatttctgaacgaagatcaccttctactttatattcagcaccgataatttcacgaatcttagcagcctgatcatcagtccaatccttaaccttcaggtcacgatcaacacctgccttatccaaaatctttgctgaactactgcgtccgataccatatacgtatgtcaacgcaatctcacctctcttgttctgaggcaaatctacaccaactattcttatagccatatactaattattttttttgcaaaaataataaattatccttgacgttgtttatacttaggatttttcttgttaataacatacaaacggccattacgtctaacgatcttacattccggcgtacgtttctttaatgatgctcttactttcatatcttattttcttttatttatatctaaaaacgattcttcctttagataaatcatagggtgacatctctacccttactttatctcccggtaatattttaatgtaatgcattctcattttgccggaaatatgagcggtaatctcatgtccgttttccagctcaacacgaaacattgcattcgacaatgcttctacgataactccatcttgttctattgcggattgctttgccatattaaattgctttatctcctaaaacttgttctataaattcaaacgatgataaaatatctgccttatctaaaccgattgcaactgtatgctcgaaatgagcagcgcacttgcgatctctggttctgattgtccaacgatcactttccattacaatctggcgatctccctgagtaatcatgggctctatcgcaatgcacattccttttttcaataaggctccggttcctctctttccgtaattaggaacctgaggaggttcgtgcatttccttacctattccatgaccgacaaactctctgacaactccatacgaccggtcttcacaatactgctgtatcgcataaccgatatcgcctaagcgctttccatgaacagcattttctattcctttataaagagcttctttcgttgtttttaagagtactcgtacttcaggatcaacttcacctacacagaatgtatatgcggaatcgccacaataaccgttcatgtaagttccacagtcgacagaaacaatatcaccttctttcaaaggaatatcattaggaataccgtgtacaacctgatcgttaaccgaagtacatagagttccagggaatggaggtccgtaaggattagggaatcctttgaatgtcgggattgccccatgatctcggataaattcctccgcaactttatcaagttgtttcgtcgtaactccaggctttatcaatttagccacttcagccagagtcttccccacaaggagattactctgacgaagcaactctatttcatcatctgtcttaagaaatatcattctgacttcgtttaataagcagcaacatttccagaacgacctttgattcttcctgagctaagcaagccatcgtaatgacgcattaacaaatgactttctacttgctggagagtgtcgagaacaacacccacaaggatcaacaaggatgttccaccaaagaactgtgcaaattctgcctgtactccaaatatacctgcgaatgccggcaaaatagctacaatggccaagaaaagagagcccgggaaagtgatacgtgtcataatcgtatcaatgtaatcggccgtactcttacccggtttaatacccggaatgaaaccattattacgtttcatatcttcagccatctgagttggattgatcgtaatagccgtatagaaccaagtaaacacaataatcagaattgcaaataccagattataccagaaactggtatggtctacaaacgcacgagcaataccacttgccgaggcaacatttgagaatccgacaatcgtaataggaatgaacataattgcctgagcaaagatgatcggcattacatttgcagcatttaccttcaaaggaatatactgtctagcaccaccatattgcttattacctacgatgcgttttgcatactgtacaggtatcttgcgaactccctgaaccaaaaggatggcggcagcgataaccagtatcaataccacaatttccaaaaggaacatgatgataccgccggcacctggagatgcaagacgagaaacaaattcaccaccgaaagcttgaggaagacgggcaataataccaatcataatgatcagtgaaataccattaccgatacctttatcagtaattctttctccaagccaaaggataaacatacttcccgcagccaaaatgatggtagaagtaataataaagaaagtccaatctaatgaagcattaagagccggacctgcctgcattttcaagttgatcaaataagaaggagcctggaatatcaaaataaagatagtcagaatacgagtatactgattaatttttcgacgtccactctcaccttcacgttgtagtttctggaaataaggaactgcaatcgccaacaactgaatcacgatggatgcagagatgtacggcatgattcccaatgcaaagatagacgcattagagaaagctccaccagagaacatgttcaacaaagcaagaagaccttcactcgtttgttcatgcaactttgacagcatatcagggttgatacctgggagaaccacatacgaaccaaatctgtagattgcaacaaacaatatagtaatgaggatccgctgtctcagatcctcaatattccatatgttctttaatgtttcaatagattttctcattgaatcagagttttactgcattaccaccaacggcttcgattgcagctactgcactcttagagaaagcgtttgcttctacatcgagtttagtagttaaactaccgttaccaagaactttcactaactggctagaagaaataaaaccagcttcaatcaagtcattaacaccgaccttagacagattcttagcttcagccaacttctgaattgtatcaaggttaatagctttatattctacacggttgatattcttaaaaccaaatttcggaacacgacgctgaagaggcatctgaccaccttcaaaaccgatcttcttagaataaccagatcttgactttgctcctttatgtcctcttgtagaagtaccgcctaaaccagaaccagcaccacgaccaattctctttctagttttgactgaaccttctgcaggacgtaaattatttaaattcatattgtaaaatcctttattattaacaatatattacttaacgattgcaaccaggtgttttaccttttcaatcatacccagaattgaaggagtttcttcgtgttcaaccacacgattcatcttacgaagtcccagtgcatccagtgttcttttctgatctgcaggagcaccaattctactttttacttgtttgatcttaatagttgacatgtttatcctccttatcctctaaatactttttccatacttacacctctgttttgagctaccatgcgagcatctctcatttcacccaaagccaagattgtagctttaaccaggttgtgcgggttagaagaaccttttgacttagccaaaacgtctgtaacaccaacactttccaatacagcacgcattgcacctccagctaccactccagtaccggttgaagcaggtttaatgaaaacttctgcaccaccgaatttagcagactgttcgtgaggaacagtacctttcaatacaggaacacgagtcaggtttttctttgcagcttctacacctttagcaatagcagctgtaacttcaccagccttaccaagtccccaaccgatgataccatcttcattaccaactacaacgatagcagagaaactgaaagttctaccaccttttgtaactttagtaacgcggttgattgcaaccagtctatcttttaattctatatcgttagtgatcttaactctattattaactgccataattcattaaaatttaagtccaccgttacgagcagcatcagctacttcttttactctcccatgatacaagtaaccattacggtcgaatacgacagtcgtaataccagcttcctgagctttcttagcgatcaattcaccaactttagcagcctgttctttcttaggcatagcttccatacccagagaagaagcagcaaccaatgttttaccgctcaaatcgtcgataacttggacatagatctgcttgttacttctaaacacactcatacgcggacgttcagcggtacctgaaatcttgttgcgtactctatatttgatcttgattcgtctttctatttttgttgtcataattgtacgattttatgtgaattacttagcgccagctgacttaccagactttctacgaatttcttcaccaacaaacttaataccttttcctttataaggttcaggcttacggaaagaacgtatttttgaacaaacctgaccgagcagctgtttgtcacaagattccaatatgataagagggttcttatttctttcagatttagtttcaaccttgatttcaggaggcaactgcataaaaatattatgagtataacccaaagcgaaatcaatgatgttaccattgttagatgcacggtaaccaacaccgacaagttccaactctttcttgtaaccttcagaaacacctacaaccatgttgtgtatcaatgcacgatacaaaccatggaacgcatgacgctgtttcaggttatcaagcatagcgttttcattttctttcaacaccacgtgtccgtctgcaatttctacttcgatagcaggatttacaaactgactcaactcacctttcggacctttaacgtttactacgttatccttcagagtaactgttactccagcaggaatactaacgggcaatttacctattcttgacatagcttatcctcctacattaatatacataacaaagaacttcaccaccgattttcaaagcagcagcttccttgtctgtcatcacacctttggaagtagatataatagcaatacctaatccattaataactctcggcatgtctttgtagccagtatacttacgcatacccggagtagatactctttcaagtttcttgatagcgttaactttgttaactgcatcatacttcaaagcaactttgatagtaccttgaggaccatcttctacaaatttgtagttcagaatgtaacctttgtcaaacaggatcttagtgatttcctttttcaagtttgaagcaggtacttctacaactctgtgcttagcactaattgcatttctcaatcttgtgagataatctgcgattggatctgtcataaaaataattgttaaattaatcaggactaccctgacaatatttaataataaaaataattaccagcttgctttcttaacgcccgggattaaaccatttgaagccatttcacggaactgaatacgtgaaataccaaactgacgcatatatccttttggacgacctgtcagtttgcaacggttgtgcaagcggattggattggcattcttaggaagagcctgcaatttctgagcagcttcaaaagcttcagcaggttcacctgtctttacaatctttttcaacgcagcacgtttctcagcatatttggctaccagtttggctcttcttacttcacgagccttcattgattcttttgccatatcttatcaatcttttttagcgtttttaaacggtaaaccgaattccttcaacaaagcataaccttcttcgtctgtctgtgcagaggttacaaaggtaatattcattccgagaattttagtaatactatcgatattaatttcagggaaaatgatttgttcctgaataccaagagtataattacctcttccgtctaacttgctttcgatacctttgaagtcacgaatacgtggcaaagctacgcgaacaagtttttcaaggaattcatacattctttcacgacgtaaagttaccatcacaccgataggcattttcttacgcaacttaaagttagcgatatctttacgagaaacagttgcaacagctttctgacctgtaattgcagtcaattcattgatagcaacatcgatgatcttcttatcagctacagccatacccagaccctgattgataacaatcttcttaagtctaggaatctgcatagatgaagtatactggaactgattcttcaatgcaggagcaatacgctctgcatattctttcttaaggctagcagtactactcattatttaatctcctctcctgattttttagcataacgaacaaatgttcttccatcagaactttctcttctaccaatacgtgtcggtttacctgttttaggatcaaccggattcaggttagagatgtgaataggagcttcctgcttcacaataccaccctgaggattctttgcattaggttttgtgctctttgataccatattgataccttctaccagtgcacgtccttctttaacaagaactttcaacacgcggccagttttacccttgtcttcgccagagtttacgtaaactgtatcgccttttttaatatgtaatttactcattacttaaatcttttacaaaattaaagtacttcaggtgcaagtgaaacaaccttcatgtttgcattacgcaactctctcgctaccgggccaaaaatacgacttcctctaatttcacctgcgttgttcaacaaaacgcaagcattgtcatcaaaacgaatgtaagaaccgtcagcacgacgaatttctttcttagtacgtacgatcagggccttagatactgcaccttttttaatatcacttgaggggataacactctttattgaaactacaataacatccccaacagaggcataacgtctctttgtaccgcctaaaacgcggatacaaagagcttctttagcaccactgttgtcacacactgtaagtctggattctgcttgtatcataattacttagctctttcgataatttcaatcaatctccatctcttagttttgctcaaaggacgagtttccatgatacgaacagtgtcgccgatctggcattcatttttttcgtcatgagcatggtattttttcgtcttagaaacgaacttaccataaatagggtgtttttccttaaacttagcagcaacagtaatggtcttatccattttattgctaaccacaacaccagttctttcttttcttaaatttctagcttccatgaggaccattattatttgttaagttctctctgacgcaattctgctttcatacgcgcaatagttctgcgtaatttcttaatctgtgcaggattttccagcggagagatcgaatgatttaaaaccatttgattgtaattggcaacttcagtctgaattctttctgccaattcgttggtagctatttctctaatttctgcaatcttcatatcaattaagcattttgacttgcgtcgtaatcacgtctaacaataaacttagtagtaacaggaagtttctgtgctgcgaggcgcaaagcttcttttgctacttcaaaagacacaccttcaacttcgatcaaaatacgacccggagttacaggagctacaaagccttctggattacctttacctttacccatacgtacgtcagcaggcttacgagtaataggtttatccgggaatatacggatccaaatctgaccctgacgctgcatatatcttgttacagcaatacgagctgcttcaatctgacgtccagtaatccacttagtctgtaatgacttgataccgaaggtaccgaaagccaactggtgtcctctctgggcattacctttagcgctacctttctgctgtcttctgaattttgtctttttcggttgtaacataattcctaaaattcaaattcgttagcgattgttgtttttctttctgcggaaattctttccaccattgttaccgtttccaccacggttgttttccttgctctgagtgaagttaggagccaactcacgttttccgtaaacttctccacggcaaatccatactttgatacccagcaaaccaacttttgtcaaagcttctgcatgacaatagtcaatgtctgcacggaaagtatgcaacggagtacgaccttccttatacatttcagaacgtgccatttcagcgccattcagacgacctgaaatcaacaccttgataccttcagctcccatacgcatcgtattggcgatagccattttgatagcacgacgataagcgatcttgccttcaacctggcgagcgatgttattagcaacaatcacagcgtcgagttcgggtttcttcacttcgaagatattaatctggatatccttatcagtgatcttcttcaactcttctttcaacttatcaacttcctgaccacctttaccaatgataatacctgggcgagcagtacatacagtaattgtcaccaacttcagagtacgttctataacgattcttgaaacgctggcttttgcaagtctggcattcagatatttacgaattttgctatcttctaacaaagcgtcaccataattcttgccaccgtaccagttagaatcccatcctctgataattcctaaacggttacttatcggattaactttctgtcccatctactcttaatttttatcattagtattcttagaatcaacgaacaaagtcacatgatttgaacgtttgcgaattctgtaacctctaccctgaggagccggtctcattcttttcagagttgcacctccatcaacaaaaatcttagttacaaaaagttcgccgtcttcagctttgcgttcgtttttctgttcccagttagcaatagcagagcgcaacagtttttccactcttgcagaagcttccttagaagaaaacttcaaaacaccaagtgctctattaacctccatgccgcgaatcatatcagcgacaagacgcattttacgcggagaagtgggcacattttgcaattttgcaaaatacatggttttaagggcttcttttcttttttcagccgatattttttttcttgctcccattatttattactttattatttcaaataagtgtcctgttattttttcttgttacctgcgtgaccacggaacgtacgagttggagcaaattctcccaacttatgacctaccatgttttctgtaacataaacaggaataaatttgtttccgttatgaactgcaattgtatgcccaacaaaatcaggcgaaatcattgaagctctagcccatgtcttaacaactgactttttgccgctttcattcatagccagcactttgttttccagttttacattaatatatggacctttttttaatgaacgactcataaattactcaattaatcagttgttattactttcttctttcaataatatacttagaagactgtttcttaggtgctcttgtcttcaagcccttagcatacaagcctgtacgtgatcttgggtgacctccagactgacgtccttcaccaccacccatcgggtgatcaacagggttcataacaacaccacggttgtgaggacgacgtcctaaccagcgagaacgacctgctttaccagaagcttccaacgcatggtctgaattaccaacactaccgatagttgctttacaagcacttaagatctgtcttacttcacctgaaggcaacttaataacacagtacttaccctcacgagaagtcaactgagcaaaattaccagccgatcttaccaaagcagcaccttgtcctggacgcaattcaatgttatgaattacagtaccaacagggatgttttcaagcggaagtgcattaccaatctcaggcgctgcactcgctccagacatcaaagtactacctacctgcaatccattaggagcaataatatatctcttttcaccatcagcatagaacaaaagagcgatacgagcggaacggttcggatcgtattcaattgtctttacaactgctggaacaccgtctttgtttctcttgaaatcgataatacggaattttcttttatgaccgccaccgatatagcgcattgtcattttacctacatggttacgaccacctgtagaacgctttccatatacaagagatttttctggtaccgatgcagtaatttcctcaaaagtaccaataattttgtgtctctgccccggtgttgtgggcttaaatttacgtactgccatcttttatttaaatattgctataaaaatcaatagtatcaccttctttcaatgtaacgatagctttcttataagcatttgtacgtccattgataagacctgatttagtataacggctcttgttctttcctgcgtaacgaacagtatttacatcaacaacagttacgttatacatagcttcgatttcgctcttaatttctaatttgttagcttcaggacgaacaataaatccaaagcggttgaacttttcagatattgccgtcatcttttctgtaaccaacggtttaataatcattcccatattacttcagcctcctttaattatttaactaaggtttcctcgatagctttcaatgcactctctgtaacaacaagagtttctgcgttcaatactgagtaagtattcagcgcagaagcaattgcaagatttgtacgctctaagttacgagcagacaaatatacgtttttatttgcttccggcaaaaccataagcagctttttaccagctactttaagattattcacaacatttacaaaatctttagtcttaggagcttcaaaagtgaagtcttctacaactacgatattgttagcctgagccttgtatgacaaagcagacttacgagccaaagccttaactttcttgttcagtttgaaccagtaatcacgtggtttaggaccaaacacacgagcaccaccaaccaacagcggagaattgatatcaccacgacgagcgccacctccacctttctgacggcctaatttacgagtagaaccactgatttcgcttctttctttagacttgtgagttccctggcgttgattagccatgtactgttttacgtccagatagatagcgtgatcattcggagtgattccgaagatagcttcattcaaagcaacctttcttccggtgtcttcacccttgatatttaaaacgttaacttccattatttctcaattattacgattgaacctttgcaacccggaacagaacctttgatcaacagcaagttgtgttcaggaattacttttaatacctgtaagttgtgagtagtaactctgtcaccacccatttgaccacccatgcgcattcctttgaatacttttgcagggtaagaacaagcaccgatagaacccggcttacgagcgcggttgtgctgaccgtgagtagtctggcctacaccaccaaaaccgtggcgtttaacaacaccctggaaacctttacccttagaggtaccgattacatctacatagctagcatcgttaaacaattctacagtgatagtatcacctaaattcaattcttctgagaaatctttgaactcggccaagtgtctctttggagttactccggctttcttaaagtgacccatcaacggttttgtagtatgcttttcctttttgtcctggaaacctacctgaacagctgcatagccatctttttctacactcttaatctgagtaactacacaaggaccagcttcgataacagtgcatggtacatttttaccatcagcactgaaaacggatgtcattccgattttctttcctaataatcctggcatttcagttaattttttaaattattaaactttaatttctacttctaccccacttggcaattccaatttcatcaaagcatctacagtcttagctgttgagctatagatgtcaatcagtctcttgtaagaagacaattcgaactgttcacgtgacttcttgtttacgaaagtcgaacggtttacagtaaagacacgcttgtgagttggcaatggaataggaccgctaacgatagcgcctgtagccttcacagttcttacaatcttttcagcagacttgtcaaccaagttgtgatcgtaagatttcagtttaattctaattttctgactcattagtaatgattaattaattatttgtatttaagatgaagcatgagggctaagagtcattcgctagccctcatcggcttcaagttattcaatattattataccaagtctacgcgacctttaacttcttccaatacagtcttagcaatagagcttgatacctgtgcatggtgatcgtaagacattgaagaagtagcacgacctgaagtaatagtacgcaaagctgttacataaccaaacatttcagccagcggaaccattgccttaacaatacgtgcgccagaacggcttgtttccattccttctacctgaccacgacgcttgttcaagtcaccgattacatcacccatgttttcttccggagtaacaacttccagtttcatgataggctccatcaataccggaccagccttaacacatgcattcttgtaagcctggatagcacagatttcgaaagacaactggtctgagtctaccggatggaaagaaccatctttcaaaacaaccttcagtgaatcgagcgggaagccagccaaaacaccattcttcatagctgtctggaatcctttctgtacagaaggaataaattccttaggtacgttaccacccttcacttcatcgatgaactgcaagccaccctgcttccaatcttcgtcaaccggacctactgtaacgatgatatcagcgaacttaccacgaccaccagactgtttcttgtatacttcacgcaattcaacagtcttcgtgatagcttccttatagttaacctgcggacgaccctgattacattctactttaaattcacgtttcagacgatcgataatgatatccaagtgaagctcacccataccagagataattgtctgaccagtctgctcatctgtacgtacagtaaatgtcgggtcttcttctgccaacttagccaaaccattagacagcttgtccaagtctttctgagtcttcggctctactgcaataccgataaccggttccgggaaatccatagattccaatacaatcggagctgtttcatcacacaatgtatcaccagtacgaatatctttgaaacctacaccagcaccgatatcaccagcgctaattacttctaccggattctgtttgtttgagtgcatctggaacaaacgagatacacgttcttttttacctgaacgagagttgtagatataagaacctgcttcaatcttaccagagtaaacacggaagaatgtcagacgacctacatacgggtcagtagcaatcttaaatgccaaagccgcagtcttttcatcttcatccggtttacgatcttcttctgcacctgttgtcggatttgtacctacaatgttcggagtatccaacggagaaggcaagaatgcacatacataatcaagcaaagtctgtacacccttattcttgaatgaagaaccgcacagcatcggaacgatttccatcttcaatgttcctgcacgcaaagcacgcaagatttcttcttctgtaatagtagaaggatcatcgaagtatttttccatcaaagattcgtcgaattcagctactttttcgagcattttgtctctccattcattagcttcatcaaccaagtttgctgggatatcttcaacgtcatagtctgcacccattgtttcatcgtgccacaagattgctttcatcttgatcaagtctactacacccttgaagctttcttctgaaccaataggaataactaccgggcatgggttagctcccaagacgtctttcatctgacgtactacctcaaagaagtcagcacccgaacggtccatcttgtttacataaccgatacgaggaacattgtacttatcagcctggcgccatacagtttcagactgaggttcaacgccaccaacagcacaataagtagcaacagcgccatccaatacacgaagagaacgttctacctcagcagtaaagtctacgtgccccggagtatcaatcaagttgattttatatttattacctgcgtatttccaataagtagttgtagcagcagaagtaatagtaataccacgttcctgttcctgttccatccagtccattgtagcagcaccatcgtgtacttcaccaatcttgtgagtcaaaccagtgtagtacaaaatacgttcagaggtagtagtcttaccagcatcgatgtgcgccatgatcccgatgttacgagtcaaatgcaaatcatgtttagccattttaattccttcttaattgattattactagattagaatctaaagtgagcaaatgcacggttagcttctgccatacgatgcatatcctctttacgcttgaaagcaccaccttgttcattgtaagcatcaaggatttcagcagccaatttatcagccattgacttaccaccgcgcttacgagcaaaagcgatcaagttcttcatagagattgactctttgcggtctggacgaatttcagtaggaacctggaaagttgcaccaccgatacggcgagatttaacttccagctgcggagttacattatctagagcttttttccaaacttccaaagctgaagtttcttcacccggaagcttagtttcaactgttttcagtgcattgtagaagatttcgtaagaagtattcttctttccatcatacatcaggtggtttacgaatttagaaaccttctgatcattaaatactggatccggcaggatcacacgttttttgggttttgcttttctcattttgtttgataataatgtttagtttggggctgcatctctgtttacttcaacacctcctccgaggcatttactcaaccttaaagcttttcctacaaaccaaaacgaattaataaaagttcttttactaaggattgtactcagctacgaattatttttttccctttgtagcaggagcctgtcctggcttcgggcgcttagcaccgtatttagaacgtctttgtgtacgacctgcaacaccagctgtatccaatgtaccacgaacgatgtgataacgtacacccggaaggtcctttacacgaccaccacgtaccaatacgattgagtgttcctgcaagttgtgtccttctcccggaatataagagttaacttccttagagtttgtcagacgcacacgagctactttacgcattgctgagttcggttttttcggagttgtagtgtaaacacgtacacaaacaccacgtctctgaggacatgagtccagtgccggtgatttactcttatctgccaaaaccgttcttccttttcttactaactgttgaatagtaggcattttgttttgattttaattattatatatattgtttattgtttttccaatccttgtcgaaactatacatttcgggctgcaaaattacaaataactttttaatagacaaactgttttaaaataaaaaaagtccatttcccgtaaaaaggcaggaaatggacttcaaaatggcttttttatatttttttaagcttctcctttaaaatcactcaatggtggaacgaaagtcttgctaccgttagcttgttcttccggcatacgtatcggaccaaaattatgctcatattttgcgacattgtcttgtagagcatacatcagacgctttgcatgttctggagtcatcacaatacgtgactgtacacctgccttaggcaatcccggcataatacgtacaaagtctaatataaattcagaagtagaatgagtgattatagcaagattggcataagtaccttgagcaacttcttctttcagctcaatctggagctggttatttttgttttcgttttccataatgactaaattttaatattaagtatttattttttctcattagtaccacaaatgtagggaaaaagttgaatcattcgaagtcttcaaccagaattttaaagaagggattcaaatttgcagacaaagattgagttgataacccctgtttataaaaagagaaccactccatcaaagtagacctttgacgaagtggttcccctctatacaatcaacctatcaggcaaactattattctacttcactatagtcaagtacatttttacggtttgccaagatacggtcgtattcttcttttgatccaacaataatcttttcaaattcacgctgacctgtaccagcaggaatcagatgaccgcagattacgttttccttcataccttccagcttatcaacctttccgttgatagcagcttcattcaacaccttagttgtttcctggaatgatgcagccgacatgaagcttgatgtctgcaatgcggcacgtgtaataccctgcaggatctgagtagatgtagcaggtacggcatcacgaacttctacaggcttcaagtcacgacgtttcaacatactgttctcatcacgcagcttacgggctgtaacgatctgtcccggctgcaagttctgagaatcaccggcatcaacaacaactttcttgccccagatacggtcgttttcttcgttgaattccaaacgatctacaacctgctgctccaggaagcgtgtatctcccggttcgtcaatctgaactttacgcatcatctgacgtacgataatttcgaagtgcttatcgttgatcttcacaccctgtaaacggtatacatcctgaatttcattcacgatatattcctgtacagccgtaggacctttaatagccaaaatatcggcaggagtaattgcaccatccgacaacggtgttccagcacgtacatagtcgttttcctgaaccaagatctgttttgacaacgcaaccagatatttcttcacatcaccagtcttagatgttacgataatctcacggttaccacgtttgatcttacccattgtaacctcaccgtcgatttccgaaacaacagccggatttgacggattacgtgcttcgaacagctcggtaacacgaggaagaccaccggtaatatcaccggccttacctacggcacgcggaatcttaaccaagatatcacccgctttaaccacctgcttgtcttcaacaaccacgtggccacctaccggcaagttatatgttcggataattccaccattctcatccagaatatgcaatgaaggaatcttcgtcttatccttagattcagtaataatgatttcacgcaaaccagtagcttcatccgattctaccttataagttacgttttcaatcactgattcgaaatcaatcttaccagcagcttctgtaacgataacggcattgaacgggtcccacttagcaatcagtttgcctttttctacgacttcaccgtctgaagcatacaatttagaaccataaggaacgttgtgcgttgacaagataatgcctgtattcacatctacgaaacgcacttcagccaatcgaccaacaacgatcttaacaggttcacctgtttcttcaacagcatctaccgtacgcaattcttcaaattcaaggcgtgcatcgttcttcgctacgatacttgcattggcagccatgttaccagcgatacctccggcgtggaaggtacgcaaagtcaactgagtacccggttcaccgattgactgagcagcgataacgccgacagcctcacctttctgaaccatacggctagtagcaaggttacgtccgtaacacttagcacatacacccttcttcgattcacaagtcaatacagaacgtatttcaacgctttcaatcggagaatcttcgatttcctgtgcgatagcttctgtaatttcttcaccagcagctacaatcagcttaccagtagtaggatgtataacatcgtgtacagatacacgtcccaatatacgttcatacaacgtagcaataacttcatcgttattcttcaaagctgtacaaaccaaaccacgcaatgtaccacagtcttcttcattgatgatgacatcatgagatacgtcaaccagacgacgagtcaagtatccggcatcggctgtcttcaacgcagtatcggcaagacccttacgagcaccgtgagtagaaataaagtactccaacactgacaaaccttccttaaagttagaaagaatcgggttttcaatgatctgagcaccttcggcacctgctttctgcggcttcgccatcaaaccacgcataccagacaactgacggatctgttccttagaaccacgggctccagaatccagcatcataaatactgagttgaaaccttgatcgtcattcttaattgtcttatacaagatatcagacaagtcactgtttacgtgcgtccaagtatcgatgacctggttgtaacgttcgttgtcggtgatgaaacccatgttatagttcatcataatctgttcaacttcttcgttaccacgtttaaccagttcctctttttccttcggaataataatatcacccaagttgaatgacaaaccaccttcaaaggctttcttataacctaagttcttgataccatccaggaattcacatgcacgggctacacccacacgcttaataacatcgctgatgatatcacgcaatgacttcttagaaataatggtattcaaataaccacattcatccggaaccagttcgttaacgataatacgtcctacagaagtttctttgatcatcttcttaacgatattgccgttttcatcgaggtcattggttacaacactgatgatagcgtggatatctacctttccttcgttgtaagcaatcaatgcttcttccggtccgtagaaaatcaacccctcaccttttgcacctttacgcaacttggtaatgtagtacaaaccaagaaccatatcctgtgccggcactgtgataggagcaccgttggcagggttcaatatattatgtgactgaagcatcaacatctgtgcttcaagaacagcttcattactcaaaggcaagtgtaccgccatctggtcaccatcgaagtcggcattgaacgctgtacatgccaacggatgcaactggatagctttaccctcaatcatcttaggctggaatgcctggatacccagacggtgcaaagtcggcgcacggttcagcaataccggatgtcctttcattacatgttccaggatatcccaaatcaccggttccttacgatctacaatcttctttgcagacttaacggtctttacaataccacgttcaatcagtttacgaatgataaatggtttgtacaattcggcagccatcaatttaggaataccgcattcacccattttcagttccggacctacaacgattacagaacgtgcagagtagtcaacacgcttacccagcaagttctgacggaaacgtccctgtttacctttcaagctatcagaaagagatttcaaaggacgattggcgtctgtcttcactgcactcgacttacgagagttgtcgaacaatgaatcaacagcttcctgcaacatacgcttttcgttacgtaagattacttccggagctttgatttcaatcagacgtttcagacggttattacggataataacacgacgatacaagtcattcaagtcggaagttgcgaagcgaccaccatccagcggaaccaacggacgcaattcaggcggaataaccggaacgatacgtacaatcatccattcaggtttgttacggcctcttgaagcacggaatgattctacaacttgcagacgtttcaatgcttcgttcttacgctgctgagatgagtcattattggccttgtgacgcaattcatatgacaatgcatccaaatccagacgtaccagcaaatcgtagatagcttcagcacccatcttagcaataaacttattcgggtcgctgtcttccaaatattgattatctttcggaagattctcgatgatttcaagatattcttcttcagacaacaaatcatattgattgataccatcttcagctttgatacccggctgaataactacatagcgttcgtagtaaatgatagcatcaagtttcttggtaggcaatcctaacaaatagccaattttattaggcaaagagcggaaataccagatatgtgcaaccggcacaaccaactgaatgtgaccgctacgttcacgacggactttcttttcagtaacctcaacgccgcatcggtcacaaacgattcctttataacgaatacgcttgtacttaccacaatgacattcgtaatcttttaccggaccaaagattcgttcgcagaacaaaccatcacgttccggcttataagtacggtaattgattgtttccggtttcaacacttccccataagagttttccagaatctcttcaggagaagccagtccgattgtaatctttgagaaattactctttatcttagtatcttttctaaaagccatactttatattttataaaatgaagaatttaagataaaggaggagcacttctcgtctcctacctttattaatatattattccaatgtaatgctcaagcaaagacctctcaactcgtgcagcaatacattcagagattcaggaatacccggagtaggcatcggttcacctttcacgatagcctcgtatgctttagaacgtcctactacgtcatcagacttgatagtcagaatttcctgaagtacatgagcggcaccgaatgcttcgatagcccaaacctccatttctccgaaacgctgaccaccaaactgtgccttaccaccaagcggctgctgagtaatcagagagtacggaccgatagaacgagcatgcatcttgtcttcaaccatgtgacccagtttcaacatgtaagtcacaccgacagttgcaggctggtcgaactgttcaccagtaccaccatcgtacaagtaagtcttacaataacgtggcaagccagctttgtcagtccacttatccaaatcatccaaagtcgcaccatcgaaaataggagtagcaaacttaacacccagttccttaccggcacgtcccaatacagcttcgaatatctgaccgatgttcatacgagaaggcacacccagcgggttcaatacgatatcaaccggagtaccatctgccaagaacggcatatcctcctgacgtacgacacgtgaaacaatacccttgttaccgtgacgacctgccatcttatcaccaacaccgatcttacgtttcttagcaatatatactttagccatctgaataataccagaaggaagctcatcaccgatagtcaaagcaaatttcttacgcttcagttcagcatccagttctttgtatttcttcaagtaattcatgatcaaatcacgaatcatatcattcttatgagcatccgaagtccatttactcagctgaatgattgtataatccaatgattccagatcacgtttagtaaacttagcacctttggcgataacttctgtacccagatagtcttttacaccctgagaaaccttatcgttagtcagaaccaacaatttttcaatcaggatttccttcagtgcagcagccttttcttcaaattcttcattcagtttcggcaaaatagccttatctgcgttcttttcactacgagtcttgatgacacgtgaatacaacttcttgccgataacaacaccacgcaaagaaggagaagccttcaaagaagcatccttcacgtcaccagctttgtcaccaaagattgcacgcagcaatttttcctctggagaaggatcagattctcctttcggagtaatcttaccaatcaaaatatcacccggttcgatacgagcacctacacggacgataccgttttcatccaagtcttttgtagcttcttcacttacattaggtatatcagaagtcaattcctccataccgcgcttggtttcacgtacttccagaatatattcatcaacgtgtacagaagtcaaaatatcttcacgtaccacgcgttcattcaatacaatagcatcctcgtagttgtatcctttccacggcatgtatgctaccagcaggttcttacccaatgccaattcaccattagcagtagaataaccttcggtcaagatatcgcctttcttcacacgctgaccttttgagcagataggacgcaagtcgatagtcatgctctggttagtcttgcggaatttaggaatacgatattctttcaatgccggctcaaagcttacaaactcttcatcgtctgtacggtcatacaaaatacgaatagttgttgcatctacgaaatcaattacaccatcaccttcagcggcaatctgtgtacgtgaatcttcacacaactgtttttcgataccagtaccgacgataggagcttcagtcttcagcaaaggaactgcctgacgcatcatgtttgatcccatcaacgcacggttagcatcatcgtgttccaggaacgggatcaaagatgcagcgatagaagcaatctgctgtggagatacatccatcagctcaacctgatcaggagtaacaacaggataatctgcatcacgacgagcttttactttgtcgcggataaatgttccgtcatcattcaacggtgcattaccctgagcgataatcttgtcttcttcttcctctgccgacaaatattctataccttccggtgacaaatctactactccatctttcaccttacggtaaggagtgacgataaatccaagatcattaatctttgcatatacacacaaagaagagatcaaaccgatgttcggaccttcaggagtttcaatcggacacaaacgaccatagtgagtatagtgtacatctcgcacctcaaatccggcacggtcacgtgacaaaccaccaggacctaacgcagacaaacggcgtttgtgagtaatttcagccagcgggtttgtctggtccatgaactgtgacagagcgtttgtaccaaagaatgaattaatgacagacgaaatagtcttagcattaatcaaatcaatcggagtaaacacttcattgtcgcggacattcatacgttcacgaatggtacgtgacatacgagccagaccgatagcgaactgattagacaactgttcacctacggtacgtacacgacggttgctcaagtggtcgatatcatcaacatctgcttttgagttaatcagctcaatcagatatttgatgatttcaataatatcttgttttgtcaacaccttcacatccataggagtatccagattcaacttcttgttgatacgataacgtcctacttcacccaggtcataacgtttttcagagaagaacaagttattaataacttcacgtgcactggcatcatcggcaggatcagcattacgcaactgacgataaatgtacaatacagcttctttttccgagttagacgggtctttctgtaatgtgttgaaaataattgaataatcagaagagttagcttcttcattatgaacgaggatattctgaataccagattccaaaatcaaatcgatatgttccggttcgataaccgttccacgatcgattacgacctcgttacgttcaatagaaacaacttcaccagtatcttcatcaacgaaatcctcagtccaagtcttcagcacacgagctgccagcttacgaccgataattttcttcaagttggctttattaaccttaacgtcttcagccagattaaagatttcgaggatgtctttatcattttcaaagcctacagctctcagcaatgtagttacaggcaatttcttcttacgatcgatgtaagcatacatcacgttgttaatatccgtagcaaattctatccaagaacctttaaacggaatgatacgagctgagtacagtttagttccattcgcatggatactttgtccgaagaatacacccggagaacgatgtaactgagaaacgactacacgttctgctccattgataacaaaagtaccttttggagtcatgtaagggataggacccagatatacatcctgaataacagtgtcaaaatcttcgtgatcggggtctgtacaataaagcttcagtttagctttcaagggaacactataagtcaatccacgttccagacaatcgtcgattgtatagtgaggcggatcgatatagtaatcaaggaactcgagcacgaagttgttgcgagtatctgcaatagggaaattctccgcaaacactttatacaagccatcgttctttcgtttttcaggcggagtatctaactgtaaaaagtcttgaaatgacttcaattgcacttccaggaaatccggatacttcatcggattcttaatagaagcaaaattaattcgttgattattagtatttgaagacatctgtatggagttaaaatgattaaattcaggtcagagaaacctgtgtaacttaatatagacgcaaaaaggttaagaatcccctttacagaggactcttaaccgaactacctgatttacaggataatcttatttaagttcaacttcagctccagcttcttccaaagttttcttcaaagattcagcttcgtctttagccaagccttcttttactgtgctaggagcaccgtcaaccaagtcttttgcttctttcaagccaagaccacaagcttctttaacggccttaacaacctgcaatttagcagcacctgcgctcttcaaaactacatcgaatgaagttttttcttcagcagcagctgcaccagcagcagcaggaccagcagcaacagctacagctgcagcagcaggttcaataccatattcttctttaaggatagttgcaagttcattaacttcttttactgtcaagttaactaattgttctgcaaaagctttcaaatctgccatttttgtatgaatttaattgtttgttactatttgataattaaagttgttttggtttagtcttaagctctggaaacgattattcagcacgttcacccaaagtcttaagaactccgtgaatggtgttaccaccagattgaagagcagaaataacgttcttcgcaggagactgcagcaatgccacgatgtctgcgataacttcgttcttgctcttgattgttgccaaagcttcgagctgatcagcacctacatagaatccttcttctgcataagcagctttcaatgcaggaacaccttctttgtattctttcaacaacttagcaggagcgttcgctacttcgctgaacattactgaagttgtacctttcaaagaatcaaacaacggtgaataatcaacatccaagctcatcaaagccttgtgaagcaaagaattcttcacaactaccagtttgataccagccttgaaacattttctacgcaattcacttgttgaagctgcatccatagcagttgtatcaaccaagtagaaatgtccgtattgttttacggtatcagccaactgaccgataattacgcctttatcttcctttctcatgattcctccttaattttagatttcgtctacagatttagggtcgattttaatacccttactcatagtacttgaaagataaatactcttaatataagtacccttagctgttgtcggtttcagtttgatgatagtagcgataaattccttcgcattgtcacggatctggtcagcagtgaaagatactttaccgattgaagtatgaacgataccgctcttgtcaaccttaaagtcgatcttaccttgcttaacttcctttacagctttagctacatccatagttacagtaccactcttagggttcggcattaatccacgaggaccaagaacacgacccagagcaccgatcttacccatgatagacggcatagtgatgattacatcaatatcagtccatccacctttgatcttttcaatatattcatcaagaccaacatagtcagcaccagcttcttttgcagcagcttcagcatccggtgtacacagaacaagcacgcgaacctgcttacctgtaccatgaggaagagatacgacacctcttaccatctggttagccttacgagggtctacacctaaacgtacgtcaatatctaatgaagcatcaaacttagtaaaagtgatatcctttaccagttgagcagcttctttcagtgagtatgctttccctgcttcaattttttctgcagccaacttttgattttttgtcagtttacccattattaattgaagttaattagttattacccgggaagtcaccttttacagcgatacccatacttctagctgttcctgctaccattgtcatagcagattcgatagtaaagcagttcaagtcaaccaatttatcttgagcgattgtacgaatctgatcccaagtcagttctgcaactttcttacggttaggttcagcagatccactcttgattttagcagcctcaagcaactgaattgctacaggaggagtcttaattacgaaatcgaaagacttgtctgtgtagtaggtaatgattacaggtaaaattttacctgccttgtcctgggttctggcgttgaattgcttgcaaaactccatgatgttaatacccttagaacccagagcaggtccaacgggaggtgatggatttgcagcgcctcctttaatctgtaatttgattagtccagcaacttctttagccatttttttaatttttaatataagtgattaacgaatagaacaacaacacgtaacaaaatgcgttattccttttccacatccgtaaagcctaattcaagcggagttttacgcccgaatattttgaccattactttcagtttgcgtttttccgcacttacttcttcaatgataccactgaatccgctgaacggtccaacactaactttcactgtttctcctacggtataaggaatattagtatcttcgctaacttcctgaagctcatctaccgtacccagtatacgattcacttccgattgtctcaaggggaccggatgttcctgaccacctaaaaagccgattacatttgtgatgtttctcaaatgatgagcaacttcgccaaccaatgcagcttccaccaagacataaccagggagataagttctctctttcacaatttttttaccgttgcgaacctggtaaaccttttcggtaggaatcaatacctgagatacgtattcaccaagatcgctgtttctcatttcagcttcaagatattctttaaccttggtttctttaccactcacggcacgaagtacgtaccattttttttcaatctcagacattcttttaactgtttattagtgcggatagataacgtcttccatgataaaacggaaggcagaatccataagaaaaacaacgagtgcaatgagtagggaagcatataaaacaaccactgcactactagaaagttctgaacgagtaggccatgatactttatggactagttcgtcataagattctttacaataattcgttatctttttaaacatattcttatcaatttagcacgggaagagaggctcgaactcccgacactcggttttggagaccgatgctctaccaactgagctattcccgtaaaaatagttcccgaattttgtttcgggaactataatcttatttcaatgactttgagtattagtcaagaagttcagtaatctgaccagcacctactgtacgaccaccttcacggatagcgaagcgcagacctacgttcaatgcaaccgggtagatcaattctacagtgatagttacgttatcacccggcattaccatatctgtaccttccggcaaagtgatttcacctgtacaatccatagtacgcagatagaactgaggacggtatttgttgtggaacggagtgtgacgaccaccttcttctttcttcaggatataaacctcagctttgaatttagagtgagctttaacctgacccgggtgacacagaatcataccacgtttgatttcgttcttgtcgataccacggagcagcaaacctacgttatcaccagcttcaccttcatccaagatcttacggaacatttcaacaccagttacaactgatttcttatcttcaccaagacccaagatttcaacttcatcaccaacttttacgcgacctgcttcgatacgtcctgttgctacagtaccacgaccagtgattgagaatacgtcttcaaccggcatcaagaacggtttatcaacatcacgcggaggcagaggaatccagttatcaactgcatccatcagttcgatgatcttatcttcccattcttttacaccattcaatgcacccagtgcagaaccacggatgataggagtattgtcaccgtcgaaatcatagaatgacagcaattcgcgcatttccatctcaaccagttccaacatttcttcatcgtcaaccatatcacacttgttcaagaatacaaccaagcgcggtacgtttacctgacgagccaacaggatgtgttcacgagtctgaggcatcggaccatcagttgcagcaactacgatgatcgcaccatccatctgagcagcaccagttaccatgttctttacatagtcggcgtgtcccggacagtcaacgtgagcatagtgacgatttgcagtttcatactctacgtgagaagtattaatggtaataccacgttccttttcttccggagcgttatcgatctgatcgaaagacttgatttcgtcagctttagtgaaacctctttctgccaatactttagtgatagcagcagtcaaagttgtcttaccgtggtcaacgtgaccaatcgtaccaatgttcacatgcggtttggtgcgttcaaatttctctttagccatagctttactatttattttgattaataatcagcttttatttacaaatcacgagctgttaccgggacttgaacccgggacctcttccttaccaaggaagtgctctaccgctgagctataacagcaaagaagaaaaaagaagagcggaagacgggactcaaacccgcgaccctcagcttggaaggctaatgctctatcgactgagctacttccgcaattttagtgggcaaagatggattcgaaccaccgaaggcgtaagccagcagatttacagtctgccccatttggccactctggtatttgcccaacttctttcaaagaacaccagtttacaacctgtgtttttcttccttttgagcctcttgtcggattcgaaccaacgaccccgagattacaaatcacgtgctctggccaactgagctaaagaggcaaattaactttacagccgcacaatctccgcgacttagcggctgcaaagttagatataattttctaatcacaaaatatttctcgcgattttttttatttaccttgctgtttttctttcgctttcagcaattgtttagacagtgcatccatgcacacatctactgattcttcaaatgtatcacttaccttttcagcgtaaaactctgtattcagcgccaaaacgcgtacaccagcttccttattcatagctgtttcaggttttactacttttaaagacacctctactttctttatattatcgcaaaacttctcgagcttctctgcttttttctgaataaaagcttccaatttttcagatgcgccgaaatgaattgattgaattcttacttccataaatacctcctttttctttacgctctaggatgagcttgttcataaacttttttcaactcctcaaaagtcgtatgggtatacatctccgttgttgtcaaactttcatgtcctagcagctcttttacagcgctcaattccgcatgattattcagcatcgaggttgcaaaagtatgccgcaacacatgtgggcttttcttcttcaacgaaacgactctcgagagataacgtttcactaagagatacaccagataaggatacatcgcctttccattcttacgaacaaaaaacgcctctccaccctctggcaaaagatcttttcttgccgaaagataagcctctatattttccttcagctcatcaccgaaaggaatcaaacgttgcttatttctctttcccgtcacctttatttgcttcgcgaacagatcaacatccgcatcagtcagacctattaattcagaacgtcggataccggtttcatagaaaacttccagaatcagccgatcgcgaagaccttcaaatccggcatcaaacgccgtttcatccagtaatcgagtcatatccgcgtccttaataaaaacaggcaaaggcttctttttcttcggccccgttactttcagcagcggatccacagaaactacaccctgacgcagcaaataatgataaaaagaacgaagtgaacttaattttcgattcacagaagtcgccgtatagccatcctccatcaacgagagcacccatccacggattatgtcagcatcgaccgctggaaagtctaaattttcgtccaactttttaaaatactcttcaaactttgagagatctgtaccataactaacaatcgttttgtcagaatagtttttctcaaaacgaagaaatttcaaaaaagaatctttcagcataaaaaaacatcgccttaattattcagcaacgaatttatgaaaaagaattcaataattcaaagtttttgcagaattattattcttctacctgatgcattttctgaacgtaaatagcacgttccatcttcagtcttttcaaaacagacggtttgtcatactgctgtctgcttctcaattcttttacaacacctgttttttcaaattttcttttgaactttttcagcgctttttcaatgttttcgccttcttttactggtactacaatcatgtttttaaaattaaagtatgttgttattaaattattcgatagtcgaattgcggcgcaaaattacacatactttctttatttacaaaactttccaatagattttatcgaaaataccctagaaatcgtacctttgcttttcatagaaagtcttagataaaacatattttatatgaaacaagagataaggaaaagaataacttcgctgcgtgtcttcatgcggcaacggggtatatcggcttttatcgtgccgagtacagaccctcattcgggcgaatatgtcccggcacactgggaatcacgtaaatggatttcaggattcacgggctctgccggaacagctgtcatcacgactcaggatggcggattatggaccgactccagatattttctgcaagcagccgaccagctggaagataccggcatcaagctttttaaagaccgcttgccggaaactccatccattgcagaatggctgggaagcgtcttgcacgctggggaaaaggtaggcatcgacggctgggttaataccaccgaagaagcagagagtcttcgcgcgtcgttgtcttctcaaggtctggaactggtttccgtaaatgatccgttcgaaacattgtgggaagaccgtccgtcactgccgctgaatgctccttttattctgccgacagaatatgccggtgtatcatgctccgacaaactggcccaaatcagggaaagcctttgtcggaaccatgccgacggtatcttgatttctgccctcgacgaaatagcctggaccttaaacatgcgaggaaacgatgtacactgcaatccggtattcatcagctaccttttcatcactcagtcggatgcaactctatatatcctgccagagaaacttacaccggaagtcaccagatacctccaccagcagggtatacggacaaaaagctatacagacatagagaaggacctgcaacattatgaaggcaaatgcgtccagctatcaccggaaacgaactatactctctattgcgctgcggcttcatcagcacctgtcgttatgctcccctcccctgtccgactgctgaaggccgtcaagaatccaaccgaaatagcaggatttcatcaagccatgaagcgtgatggcgtagcaatggtgcgtttcctgatgtggttgaaggaagctgtaaaaagcggcaaggaaacggaactgtctgtcgaccgcaaattatacgaactgagggctgaacagaatcttttccaagggatcagtttcgacaccatcgccggctatcaggctcatggagccatcgtacattatgaagcgactcctgatactgatgtgaccttgcagccggaaggacttcttctgctcgacagcggtgcacaatatctggacgggactacggacattacacgaaccatcgtattaggcaaactatccgaagaacaaaaaacggactatacgctggtgctgaaaggcttcattgccttgtcggaggctgaatttcctcaaggtacctgcggcacacaactcgacgtacttgcacgacagttcatgtggaaagcaggtatcaactacggacacggtacagggcatggtgtaggacatttcctgaatgttcacgaagggcctcatcagattcgaatgaaccatgtgtcgactcctttgtgccccggcatgaccattaccaacgaaccgggaatctacaaatccggacgttatggtatccggacagagaacacgatgcttgtagtaccgtcccgtgaaacagagttcggtgtcttctataaattcgagcctctcaccctctgcccgatagacaaagaagctatccgtacagacatgctgacacaggaagaaacagaatggctcgacaactatcaccggaaggtattcgaggttctgtcgccaatgctgactgccaccgaacaggaatggctgaaacgtgcaacctctcccctacaagtataacctaaaacaacaagattatatggcactgattaaatctgtcagaggatttactcctcagattggtgagaattgttatctcgccgataacgcaacaatcataggcgatgtcgtcatgggacgggattgcagcgtatggttcaatgccgtactgcgcggagatgtaaattcaatccgcatcggcgaccgcgtaaacattcaggacggaaccgttctgcatacactttacgagaagtcgaccgttgaaatagggaatgatgtttccatcggacacaacgttacgttgcacggagcctgcgtacacgacaatgcactgattggaatgggctctacccttctcgaccatgccgttgtgggtgaaggagcaattgtagccgccggagcactagtcttagccaatacggttatcgagcctcacacgctctggggcggtgttcctgccaaattcatcaagaaagtagatccgcagcaaagtaaagaactgaaccagaagatagcaaacggctatctgatgtatgcgtcctggtttaaagaagacgaagcgcaaggcgataataaataatgactagtcctaaataaccgttacagttattggacaaaaataaattatttatcacagttcagcaaggtcagtcttgctgaactgtttgtttttgtaacttttaattttaatcagcttctgatgatgcatatactccggcgttttatacccacaagagtaatgaggtctgatgttattatacttgtagacagcatcccttattacctgtttcatatctgatagcggtagattaagttcctcaagcaggaactcctgttttagtattccgtttattcgttctgccacggcattagcgtacggatcgtaagattcagtcatgctgggtatgatgtgatattgtcccagtaatttctgatatgcatcggaacagtactgtataccacggtcagagtggtgtatcaatggcgtgtccctatacagtcggttgcggtttgccatcctcagcgcgttcaaagaaccttgagtgtccaaggaatcggaaagatcatatcccataatcttcttggaataagcatctgtaaccagagaaagatacatatgccggtttctattgccaatataagtaatatcagaaacccatatttcttccgggcgtgtcgcttccatactttctacaagattcttgtgcttccgaaaccggtgatgcgagttggttgttacatgatatgaacgtacgggctttataagcagacggttggcacggagtatatcgaacagtttgtccctgcctaccttgttctccttaagtggctgatgaagcatatgataaagtttgcgggttcctacacgtggcagttccattcggatatctcgtaccatgcccacaacatcagtggccctttgccggcctcggattatcttccattgctgacggtaatatttctgcctgcttatcccgagcagtcggcagattccgctgatacttacggatttttcttctttatatttattgactgttcgggagaggagttttttcgtatgtcgatattatattccttttccgctatgtctatcatcatgtcgaaaaactctgctttcatatccttcagctcaagctccttttccagacgggcattcttgcgttccaggaaccttactttctgttgtagttctaacagtttttgatccttactcttttccatagaatggtaacatttgtttgtgatatcaaagttaccatatttttcaatccaacggctaatagttgaacatccttgtatcccatattttcgtttcagcgctcccaaacttatttttgtggtttcatactcttgcactactgatagtttaaaggacatactgtaatctttttgtgtgcgcttaacgtactttgtttctgtcttttccataatgttaccttttttgttgtaacgctatttcaggactagacataacgattaaaaaaggaggacaaatcacgcttatgtcggtttgtcctccttttactttttattttactgcctcatatttgataaatttcccgtacgcattaaacagccatcgggtaccgtctatcagcgatacgtggtaatttccatcttttcggtcaacatccgttatacccacatcagccgctgtattcttccagtatgaaacaatacccgaaggcaacaacgaaagcatcgaatccggccagatttgtccgcctccatttacgcgcaaccactcgtagttaccgttgaatacaaatccaaagccattgggcaatgcggcagacacaagcggatgactgtaatcatggttccacgcgatagtcatctgatgcacctctgtaaaataattcttcaggaaatcctgaacccgaccgattttaatgacaaacgttttctcaccctcataagtacaaagcgcctcatcaggccggacctgcaaggtatagtaattctttttgtcgcaggagattgatgtgattcgtgcatccggctcatactcacaaacctgagttcttactttctgaggcaacaaatcgagtacggtctgcggcagttccggaaacaacatttccccgtcttcggctactgacaccctgtcaaattctccgctcaccgacatccattccccttccttgtcgaagagaagcagatatgtatcgtctatccacacccgataagccggcatggcagcactcagagcctccggtcccaagataatccgtgtgaccgttccttccggaaaagctttcgatatgcagtctttcacctttgccggtaaatattcttctccggtttctgcactgtattcatagcccagacaacgactcccttcatgctggaataccagccttctaccgtcactcagttcggcactgacaccttccttgaccgcataaacagccgatacagatatctcaccaaactttgcttccataaagtcgtacatctctttcagaaacttacgcgcaaaaatctgcattcctgcatcaggaaaggcaacctttttccacaccccctcgtgagtaaaatccacctccacattgttcgacaagacgacatgatatcctccgtccccctcgcttacccgtgaaatccgttcaatcattgctccagagaagcgtcctgatacaaacaacgatatatcggaaggaacctcttgcacagaaacagtctcctccatatcatcaccagaacaggaagtaacccacggaagcactccacataaaacgagagtcaaatagcataaatagaacagcttcttcataagtccgcagaattaagtcgttaaagttaagcattttagacgaaagaaacgaacttttcttgttaaaaagcagacaaattccgaaaaggccttcacaccggtgaaaaaagaccgcaagaaacgacctgccgtttgtacaaaacattttaatttttgtacaaatttcccgatgttttgtacaaatctccggaaagactccggcacaacatctacataacctgccgatattttctcttttacttctccatcttttttcgggaacaattacaacaaatgcaattcactggcaataccgaaagcctgagccgagttacttacctgtagcttctgcaagatattttgtctgtgacgactaatggtatgtacactgactgacagttcatcggcgatctccttgctcgacttacccatccctatcaatgccagaatttctttctcccgctttgaaagcaaatcggagcagtcgtaagtatcaatatccatgcgggttccatcgaccgaattcacgattccgtttcttcggaaaggtatatcggacagattatacagacataaggccagacaaatatttccggtatcctgtgctacgacataaaacatccgatgcaggacccagcaatatttcccccagccatcgcgcatttggagatattcctccagatagtaattgctgcgttcctgctctggaaggttcttcagaaaatgcaggaaacgtaattcacgggtatgctttttcaacagatcatcgggataaatccggccgaaaatgtcttcttcccagatagaatcaataacatgacatgctccccgcaaagcgattcccaacgattcacctaccttcccataaaaaatatagctccggttggaacccatatcactcaatactgcgattgaattctctacttcggcatacatcgaagccacctgcttataatgcatcagatactggttcaggttgtcatcgccggcaaaatcctgttcgagcagctcattattcagtttcttctttatattcatagtatcaaaggatagcgaaaattggttatttatcagtattgatgctttccacagggaaagctacttttgcaaaataatagaaaaagtttcacattataaatctataagtttatgaaaaagctctttttagctattctcacttttataagcacacaagctatggcacagacgctggaaaaaatgcaatggtttaatgaaccggaaaactgggaaataacagacaataccttgagcatgtctgtcactccgcacagtgactactggagaatctctcactacgggttcactgtagatgatgctcctttttactacaccacctatggaggggaattcgaagtgaaggtaaaaattactggcgactacaaggtccgtttcgatcaggctggtctgatgctccgcatcgacaaggaaaactacatcaagaccggtatcgagtttgtcgacggaaaattcaatctgagtacggttgttactcatcacacaagcgactggagtgtcattaccctcgacaagcctgtaccttacatctggataaaggcagtcagacgactggatgccgtagaggtattctattccttcgacgacaagacttacgtgatgatgcgaaatgcatggctgcaagacaacaccccagttcaggttggtctgatgggagcttgtcccgacggtgaaggattcaacgtaaaattcgaaaacttcaaagtaactcatctgccagaccagcggagaatggaatggctgaagaaaaatgctgaataaaaagaatcctgctttgttgttttaagccaaaaccaaagtttcatatttatcctacaggcgcagggctttcttccaagatgagccctacgccttttatcgttttcagctgtaccgtactgtcggaagcaagcattttccgtaaacgtgaaacgaatacatccagactacgcgatgcaaaatagtcgtcatctgtattccacagccgttccaaaatagcctcacgtttgacgaccttatttttgttttcacacaaaatacgcagcaaagccgcttcacgctcggtcagcgtccgttcctctcctcctgtctgtttcagcaaggcatgcccggcttcaaaaataaaggagctgccgatatggaacttttcttcttcatttgccagtcttattcctctggtgagtttcagcaaagcaaggatatgtgcgttcaactcttcggcaagaaaaggtttcttgatgtaattattcacacccagttcatagccttttaccacatccttgggagaaacacggccggaagtgaacagaataggtgtcacatcgtccgtttcgcggatacgtctcaccatttcgtatccatccatcaccggcatctcgatatcggcaacaatcacatcgggatgtgcttccttccatatcttcagtccggtttcaccattgtcggccgtcaccacctcgtaaccgcctatcatatcctccagtccgccacgtatgatgtagcacagattggcatcgtcttctaccagcaataatcgtatcattgttccattatcattattcattgttcttcttcgggcaactttctttcggctgcattttcttcagcgggaagatagattgtaaacttgctgtactctccttcaatactttccagcgttaccctgcccccatgagcttcgactacccgcaacacataattcagtcccagtccgaaacctgccggacctccgtaccgacttctgcctgctgccgaggcacgttcgtacttctcgaatatcttgctctggtctttcagcggaataccgaagcctgtatcgtgcacctttatataatcttcccccggaagccttcccgaagaaaaggttatttccacctcctcccccgaatacttcacggcattgtcaatcagattgctgagcgcttctttcaggaactcctcatcggcataaacagtgtcggcctgcaaattccatcgataagtaatatgcttcaaggcttttgccttatatttttcggcgaggtcttccagcatcggacgaaggctacacgtttctttttctaacttcaactggtggttttccagtttagagagggtaagtaccttgtttgtcagcgagagtaaatgctctccctcttctttcaatatccggaaataacgggctttcttttccgactgggcatccagctttccggtttccagtatctgtgtacccatcagaatggaactcaagggagtcttcatatcatgaatcatggcatacgaaaagtcttcccgcagtttagctatcttatcctgacggacaataatgcgtatttgatatatgatgcagactatgaccagtatcataatcagtacggtagcaagcaagagtaatgtcatccgctgaaaaatcacccaatacggattggtaatgactccttgtaaaaagcgatttccgtcgaggctgatgggaagaggcgaggtacgcaatatacctttgccatttatatcgaatcggctggaggacttgataacccaaccggttgagtcgacaatacacgacgcgacagccgcagaaaaacctatcgagtcgagcatgtgcgtataaatggagtccaggtccgtaaacgaaacatcccgattaaaatctttcagagcaatttcctgaaacgaaacatgcatgtagctcatcagccattggccggggttagacagggtttccatatctttctcggcatcgaagttgacgctcattgtaaccgtggagtctttctttgtcttagatacgcgcagaaaaacctcttgtaaggctgcttcgggaaacagttcctcccctttcatctgaatgctttccttggtcagcttatatgtgttgacaagccatacgtattgcagctcaacaatagcaataagtcccaccacagcaatccaacggatatgttttatctccataagtcgtacattaacgtaacattaacctgcccttaacctagaaagccggtcgggctctttactttcgcattgtcaaagatatagaaaataacccaatgctatttgatatgaaaatctattttttaatgagtatcttcttgctggcaggaggctcaggcagcctgacggcacaaaccgtttcgggtaaggttgtcgatacagaacagcagccagtagacggtgcaacgatcattttacagacttccgactccgttttcgtggatgcaacaatttcaaatgccgacggaaactttgtattcaatcatcagccggaagcttatcggctcatttttcagcatctcttatatcatacactagagaagaaaggtaaaggaaaagatgcaggcatcaccgtaatgcaggcaaaagactatgcgctggatgaggttgttgtacaaggagaacgaccgctggtcaaggtagaaggcagccgcctgacctacgatatgcctcaacttacggccaataagctggtgacgagtgtatacgatgctttaaaacaactgccgggtgtcatggaacaaaatggcgtgttgacgctggcgggagccggaagtgtgagtatcattttaaacgggaaaccgacatctatgacttacgaacaactcattactttattaaagggaatgcctgcatctcgtgcagaacaggcggaagtgatgtacaatactcccccgcaatatcacgtgcggggtgctgcaatcaatgtaatactaaaaggttataagccgggagaaggaggactgcaaggagaagtgaagggcagttatgtacaggcagataaggcgggaggagaaggaggtgtgacattggcttatttatctcccaagatagacatagactttatgtacaatctcaatgacaactataaccgtcagggacataaactagttactcgccatacattaaaccatgaaatacacaacatcagtcagacaacaaatggagaaagccgggatttaattcatacattacggttgggaagcaattataagttcgacgaacacaaccagctcgaactgagttatacttccagcctccaccctgataaacagcaatcggttacttcattggataatacttcgactaccttcaaccatgctccggccgaaggacagatgcataacgtagctctgaactatacctccggcttcggcctgacaggaggcatcgactatacctatttcaggaataaagaaaagcagtctttccaaagtaaagaaacgaatggacaagaaacggcatttctcagcaacgcgactcaatctataaaccgatggaaggtatatgccgatcaaagccatacgcttcccaatgagtgggtgctgaattatggaacttcttttgcgtatgtaaacaaccgtaattcacaagtgtacgacctcgctgagatgagcggaatgaacacaaaaaatcaaattgacgaatatacctataacctttatgcaggtttcgaaaagagttttggcaatcactggaacctgagtgcagctgccaccatggaatattatcagatgatgagctataaaaagtgggccgtatacccgaatttgaacttgagttatgtactttccgcatcacatatcttccagtttgagttcagttcggacaagacttatcccgattactggacactaagcggatcgaccggctatctcaacaactaccaggaaacagcaggaaatacatcactcaagccttataccgattactctgctgccctgacgtacattctgaaaagcaagtatatcttccagctcagctacgattacattaaagactacttcatgcaaatgatatatctcgactccagccggctaaaagctgtatacaattatcagaactgggactactcccaaatatttgcttttacttctgttatcccattcaagaaaggagaacgatgggacagtcagctgatgctatgcctgtcttcactgcatcatcgggcaagcaactactacgatgctcctttcgaccgcaaaatatggaacatagctggaagctggaccaatacgcttatcctcagcaagcgccccaatatcaagatggaaatcagtgcgaccggcacttccaagtccatacaagggagctataccatacaacctgccgcattcatccatgcagcactccgttatacttttgcagaagataaagctatgattcaaatcaaaggaaatgatttatttaacggcagcaaccacctgaagacgaaagtccgcaatggcgatcagattctggatatggatattgccaattatatgcgtaactttactgtatctttcagctataaatttggagggtacaagaaaaaggaagtaaaggatgtagatatttcccgtttcaagcactgacaagtcggtcggtcttcctaaaaagaaattcagtttaccaacctcagccagcatgagaactgcaataaaaagagcagcaggcataccagtcactatccagacccgtatgcctgctgctcctatcttacttattataaagaaacagtattcattatcttttccaaggcgccggcattgttacgtacataatcgccggcattctttcctgcttcatgcaggcaagcctcatccgaaaggaactcatccatcaagcagtcgaagtcttccttgccctgaatctcgaatcctccccgacaagccttcagaccttgtgcctcgaggaacttataattgttcggaccaaagatgacaggaatgccatatactgccgcttcgagcgtattgtggatgctgactccgaagccgcctcctacatacgatatttctccgtatcgatagatagaagacaacagtccgaaacaatcgataatcagacagtcggcctgtttcacattttcttcggtagcctgtgtataacgtactaccggtcgcttcagtttcccgatgatttcctgcaaatgactttcgtctatcacatgaggagctataatcagtttcatttccggatgctcattaaaataagggatgaagatatcttcatccggagcccatgaacttccggcaacaaatgtctgatgatttcctcctttaaagctttcaaccaacggcaactccttggcctgattacgtatttccagcactcggtcgaaacgagtatctcccacaaccgttgtacgagtgacgccgataccttccagcagacggacagattcttcattctgcacaaaaagatgatcgaaacatttcaatacgtttttataactgcttccgtaccaacggaaaaaaatctgtttcggtcggaagatagatgatacgctatataccggaatattacgacgcttcagttcactcaaataattacgccagaattcatatttgatgaaaaaagccatgtaaggatgagccaggtcaatgaattttttcacattgcgtggagagtcgagcggcaagtagcataccacatccgcacccttataatccttacgaacctcgtaccccgaaggagagaaaaacgtttgtagaatcttatattgcggatattgctggcgaatccgttcaatcagcggacgtccttgctcaaactcacccaatgaagctgcatgaaaccacaaatatttagcctgcggatcaatgtgttgcttcaagacagtaaaagattctttctcacctttcaccatcttggcaacttttttattaaaaagtgcagccaaatggactgcacttatatataggccaataacaaaattataaatcatttctgctttttatttgagtacctctactgcacgacgcatacgtctaacagtttcttccttacctaatacagccgagatatcaaacatgtgagggccttttccttcgcctaccagtgtcagacggaaggcattcatgatatttcccatgtggtaaccgtggtcttctatccacttcataaccacttcttcctgatgagccagtgagaaatcgtcgagtgattcaagcaggtcggccagttcggtcatacgaacagctgaatcttccttccaacgtttctttacagtcttttcatcatactctgtaggagctacgaagaagaacttgcaagtatcccacaattctttgatgaagctgacacgacctttcatcaaacctactacagtcactactgtttccataggagcttcgatgccgtgttctttcagaataggcataaacaaagaagcaatttcttcgtcgctcttcatcaggatatattcgtggttaaaccatttacccttttcataatcgaacttagctcctgccttgctacaacgatgcaggtcgaacaacttgatcagttcgtccattgacatgatttcctgatcgtttccaggattccatcccaacaaagccaggaagttgataacagcttcgggcaaatatccagattcacgatagccggaagaaacctctccagtcttcggatcatgccattccaacgggaataccgggaagcccagacgatcgccgtcacgcttgctcaacttaccgtttccatccggtttcaacaacaacggcaggtgggcaaattcaggcatcgtatcttcccaaccaaacgcacggtacaacaaaacatgcaaaggagcagaaggcaaccattcttctccacgaattacgtgagaaacttccatcaggtggtcatcgacgatatttgccaaatgataagtaggcagttcatcggccgacttgtacaaaactttatcatccagaatagaagagttgatcactacctctccacgaataatatcgtgtacatgtacatcttcgttcggttcgatcttgaaacgcactacgtactgagtaccgtcggcaatcagtttatcgacctcttccttcgacattgtaagtgagttacgcatcgaattacgagtagaagcatcatactggaagtttggaatttcctttctcttggcctccagttcttccggagtatcgaatgcgatataagccttgccgttatcaagcagtacttttacatatttcttgtaaatatcacggcgctccgactgacgatacggaccataatttccgccgaaactcacaccttcatcaaactttatgcccaaccatttgaaggattcgataatgtactcctccgcacccggaacaaaacggttggaatcagtatcttcaatacggaaaatcaaatctccgccgtgctgacgcgcaaacagataattatacaaggcagtgcgcacaccaccgatatgcaatgcacctgtcggactcggtgcaaaacgaactcttacttttctttctgccatagtggtctttatctaaaaatacgccgcaaaattaagctaaatttcccgtttttttcttattttgcacgcaaaatatcctaacacatgaaaagtttccagacagaaagacagttttcatacaagaaactattgtataaatgtgccattttcctggcagcagttgtggtgattgtgtattttttaccccgggaaggcactttcaactatcagtttgacatcaacaaaccatggaaatatggtctgttacaagcatcgttcgacttccctatctataaaggagacgaagaagtccgccgggaacaagacagcattatgacaaactatcacccttacttcctgctctcggaaagtacgggagaaaaagcgatcaatcagttcaaagaggactataacaagaacctgcgccgaattattccggacccgacttattcccaccacatagaacgcatactgaagaacgtatatgaaaagggaatcatcccggtagaacaactgggaaatttacggaaggacagtatgcggagtatctatattatcaagaacaatacatctatcctgcaaagcaccggtgaaatatataccaccaaacgtgcttacgaagagctcatctattcggatacactgcattacaacagaaacttattgcagcgttgcaacttgaatgagtatctgactccgaaccttatctatgattccgaaaaatcggaagctgccaaaaaagatattctgtcgggcatctcatgggcgaagggttttgtcatgaacggacaaaaaatcatagaccgtggagaaattattgaccaacggacatttgatatattgaaatcgctccaaaaggaatgggataaaagaggtgaaaccattacggagaaacgtctgactctggtaggacaaattttatttgtttctatcctgataggatgtttcatgacttatctcgctttgttccgatacgattattatcagaaaaaaggaagtctcgggttattatttttcctgatcatcttcttccccgtgatatcggctatcatggtttcacacgctttcatgagtgtgtatatcgtaccgtttaccatgctcccgatgatcatccgtatttttctcgactcacgtacggcatttatggcacatatcatctccattctgctctgttccatctgtctgcgtacaccacacgaatttatcttgctacagaccatagcaggtatggcaagcatttacagcttgcgggaactctcccagcgttcacaattattacggagcgccctcatcgttgtcgtagcttattcggttttgtactttgcgctcgacctgattcatataaacgatattgcacagcttaatacatatatgtatgtcaatttcatcatcaacggtattttgctgctgtttacctacccgttgttgttcattctggaaaagaccttcggctttacatcgaacgtaaccttagtcgagctttctaacatcaacaataagctgatgcgggagatgtcggaagttgctccaggtactttccagcattcgctccaacttgccaacttgacggcagcggcagctaatcggatcgatgccaacagtcagctggtacgtacaggagccatgtatcatgacatcggaaagatgctgaatccggctttcttcaccgaaaatcagacaggggtcaaccctcacgaccagttgaattacaagcaaagtgcacagattgttatcaatcatgtaatagatggtatgaagctggcagaaaagaatgacctgcctcaggtcatcaaagactttatccgtacccatcatggaaagggactgacgaaatatttctacatatcttatcaaaacgaacatcccggtgaagaagtcgataaggaagctttccgctatccgggccccaatccgtttaccaaagaacaggccattctgatgatggcagattctgtagaagcagcctcaagaagtctgaaagaatacaccgaagaaagcatatccggactggtagacaagataatcgacagtcaggtacaagaaggatatttcaaggaatgcccgattaccttcaaggatatcgctactgtaaaaagtgtattcaaggaaaagctgaaaacgatgtaccatactcgtatcagctatcctgagttgaaaaaataagttatggctgggcagtcagactgtcgagcagacctttacaggcatcttcaaggatatcgagcacattttcgaatccttgagcgcctccatagtaagggtcgggtacataatctaccaccttcgtctggcaataatcagtcatccggccgattttccgttctgtttccacatccggtgccttttctttcaaggcatcgacgttgtggtcatccatgcccaatatcaggtcgaaatcataaaagtcatcggtacggaccggacgtgaacggtgcgttatatcatacccgcgacgaatggcatgcgcacgcattcggtcgtcggctcgttctccttcgtgatagctactaataccagctgaatcaacttctatttctttctccagaccagcctgtttgatataagtacgcataatctcctcagccgatgaggaacgacatatattgcctaagcagacaaacaagattctcttcataccttaaatatccaaatactttttaaacttatccacactcgtattcataatcagttcttctggaaactccgcttcattcaccagttccaatgcgtaatcgtacgtagcaatgtcaaatgaaatatgcgcatcgctacccaaaataaccggcacctcataacggcggcacagtctcaatatttccagattattggagcgggcatccactttgccccggcaaggcttcaaggaagaattgtttatctccagcagcgtatgatgttccttcgccgcaagcacaataggttcaaaattcagtttagccgttccgtcgcccggatgactgatgatatgaatataaggattggaaacaacctgtatcataccatgtgtattttcttcaggagtaccttgtttataacaaagtgaatgaatgcctgctatacgcaaatcgagcatcttcaaataaaactcatccaaatcaaggttaccatcaccgtcaagaatattaatttccgcacccaataataaatctatcccatacatgtggcgaggcaccacataaagattacggaaataaatcgggttgcacgtacccggtatacttggagcatgttctgtgattccaagcaatttcagtcctttgccggcagcagcctgtgccatttcctgcaaggagctgaatgcatgaccgcttgctacggtatgcgtatgtacatccagttctactttcatatccataaattttacatcggatcgacatcataataaaccagcaaggaacgaaaacgttcatcctctatgatggctcgttgtacttgctggagatactcacgcactttcgacatcgaagcctgttgttctattttcactactatttttctaataaacaaagtctgtatacgtgataccggcggacggtctggtcccaatacccggtcccccagtccgtttcgcagataccccgccatcaggtcagccgcctgttcgagcactccctccttccgatgcttcagataaacataaatcagtcgataaaaaggtggatatttaaacaagcgtcgttcgtcaatctgtgtttgatacagaccgttataatcgtttgcaacgacctgatgaatcagcggaaggtcgggagatttggtctgcaacaccaccagtccctgcttattctttctaccggcacgccccgccacctgagccatcagttgaaaggcccgttcgtacgaacgaaaatccggatagttcaacatcgaatcagcattcaggattcccactacactgacacgatcgaaatccagtccctttgaaaccatttgtgtacctatcaggatatctgttttcccttcctcaaaatcggcaatgatccgctcatacgccgtacgtgtccgggtagtatccaagtccatacgtgccacacgtgcctccggaaaaatcaacttaatatcgtcttctatcttctcagtaccaaagccacggttcatcaactctactccaccacaggctggacaggacttaggtacctgataagtatagccgcaatagtgacaggtaagctgattcaatcctttgtgatacgtcaaactgacgtcacagttcttgcacttcggcacccatccgcacgtacggcattctatcatgggggcaaaccctctgcgattctgaaaaagtatcacctgttctttctgatccagcgcttcacgtatcttctgaagcaacaaaggagaaaactgagccgtcatccgtttctttcgggccagctctttgatatctactacctcgatatgaggtaactgaatctgctgatgacgctccgtcaactgtacccaaccatatttcccgttcacggcattataataggtttcaatactcggagtggctgtacccaacagcgtctttgcaccgaacatggatgccagcatgatggcagcgttacgtgcatggtaacgtggagcaggctcttgctgtttataggtattttcatgctcctcatccacaataaccagtcctaaccgccgaaaaggaagaaagactgacgaacgtactcccagtatcacatcataatcctgatcggtaagttgtttacgccatatctccacacgttcggcgtccggaaacttggaatgataaattcccagtcgatttccaaacactcgccgcaaacgttcggttatctgggtagtcagggctatttcaggcaacagatacaatacctgcttacctgcctgaatggcctgttgtatgaggtgaatgtaaatttccgtctttccgcttgccgttactccgtgaagcaaacaaacattcttctgatggaaatgtgccaaaatctccgtataggctcgttgctgagccatgctcaacggattcaagccgactgtttcaacaggaccttcggacaaacgtccgatttcgaaagtataagtttcaaaaatatgtttttccaccagcccgttaaaaactgaatttgttgctcccgtagcatccaacaaagctttacgagagacttctttgggatttttcttctcgccgccccatcctgacaactcaatatacttcatcagtaaagccaattgtttcggagcacgtgccagtgtttcgaacagacgatgtacagtttcttccgcctgcataccttcagtcaggcgtacccgcacctcaacacgcggtttgtagcttctcttcagctcctcttttaccctgatagcttccttctccaacaaagatttgattactggcaacagattctttatgccacttgccttctccaattgggtaatgcattgttccgaatcatcggacaacaaatcaagaatgcgctgttctttctcgggcagaggcttgtctgcctcaaactcaggattggataccacgagcgtttcgctttccagtttcatacccgaaggtagagcggccttatagacatcacccaatgtacacaaatagtaatctgccagccatttccagaaatcatactggcgtttcaacagaacaggggatgtatcaagtacttctacaagatcttttgtttcataagtttccggagcactctgatgtacgctagtaacaattgccgtataaaacttcttacttccgaaaggaacaacaatccggcaacccgccttcactttatcttccagatcagccggaacagaataagtatattgtccggcaacgggcaaaggcactatgacatccacgtacttcttcatggaggcaaagttacaaaaaacaaggctatcccgttggaacgtcggacaaacttttatagttttgtaaagaaactcttaatccattatcaacatgaagatatataagataggtataataggttgtggaggcatcgctaaaaaaatggcagcaacacttggaaagatgaaagaagtgcaacgttatgccgtagcatcccgcaatcaggaaaaagcacaagcctttgccaacgaatggggatttgaaaaagcatatggctcttacgaagaactggcaaacgacccgcaggttgatctaatctatattgctacaccacatgccatgcattatgacaatgcccgcatgtgcatcgaaaaagggaaacccgtattatgtgaaaaggctttcacagccaatgcccgtcaggcagaagaactactcagctttgcccacgaaaagaaagtatttattacagaagcaatctggacccgatacatgcctctttcactaaccatacaagacttgactagtcctaaataaccgttacagttattggacaaaaataaattatttatcacagttcagcaaggtcagtcttgctgaactgtttgtttttgtaacttttaattttaatcagcttctgatgatgcatatactccggcgttttatacccacaagagtaatgaggtctgatgttattatacttgtagacagcatcccttattacctgtttcatatctgatagcggtagattaagttcctcaagcaggaactcctgttttagtattccgtttattcgttctgccacggcattagcgtacggatcgtaagattcagtcatgctgggtatgatgtgatattgtcccagtaatttctgatatgcatcggaacagtactgtataccacggtcagagtggtgtatcaatggcgtgtccctatacagtcggttgcggtttgccatcctcagcgcgttcaaagaaccttgagtgtccaaggaatcggaaagatcatatcccataatcttcttggaataagcatctgtaaccagagaaagatacatatgccggtttctattgccaatataagtaatatcagaaacccatatttcttccgggcgtgtcgcttccatactttctacaagattcttgtgcttccgaaaccggtgatgcgagttggttgttacatgatatgaacgtacgggctttataagcagacggttggcacggagtatatcgaacagtttgtccctgcctaccttgttctccttaagtggctgatgaagcatatgataaaatttgcgggttcctacacgtggcagttccattcggatatctcgtaccatgcccacaacatcagtggccctttgccggcctcggattatcttccattgctgacggtaatatttctgcctgcttatcccgagcagtcggcagattccgctgatacttacggatttttcttctttatatttattgactgttcgggagaggagttttttcgtatgtcgatattatattccttttccgctatgtctatcatcatgtcgaaaaactctgctttcatatccttcagctcaagctccttttccagacgggcattcttgcgttccaggaaccttactttctgttgtagttctaacagtttttgatccttactcttttccatagaatggtaacatttgtttgtgatatcaaagttaccatatttttcaatccaacggctaatagttgaacatccttgtatcccatattttcgtttcagcgctcccaaacttatttttgtggtttcatactcttgcactactgatagtttaaaggacatactgtaatctttttgtgtgcgcttaacgtactttgtttctgtcttttccataatgttaccttttttgttgtaacgctatttcaggactagacataggatgaaataaaagaagaggttgtaaactaaatgtttacaacctcttctttttgtggaccagccagggcttgaacctgggacctccagattatgagtctgttgctctaaccaactgagctacaagtcctaatataagggggctccttaaatctgagtgcaaaagtaatagattagcctgaaacttgcaacatttatggagatttttttataaaaaaaactaagtctgtacaggcatatcaatatatattgtatttttgtgctacttaatcaattaataactaggcattatgtcacaaagcacaaatgaaccacatctgaccggactgaccgatcaagaggtcatagcgagccgggagaaaaatggaattaatctgttgactccccccaaacgtccttccatctggaagctatatctggaaaaatttcaagaccctgtaattcgcgtactgctggtagctgcggtattctccctgattatttcaatcatcgaaagcgaatatgccgaaacaatcggtatcttttttgcaatcttcctcgctacaggtatcggattttattttgaatatgatgctaataaaaaattcgacctgctgaatgctgtgggagaagaaacccctgtaacggttatccgtaacggaaaaatcaaagaaatacctcgtaaagacatcgtagtaggcgatattgttgtgctgaatacaggagaagaagtccctgccgacggaacactggtggaagccgtttcactgcaagtcaacgaatcaactcttaccggagaattgatggtgaacaaaaccaccgataaggcacattttgatgaggaagctacttatccgtcgaatgccgttatgcgcggaacgaccataaccgacggacacggtatcatgcgtgtagaccgtgtaggcgatgcgacagaaatcggtaaggttgcacggcagtctaccgaacaaagtcaggaacagacgccgctgaatatccagcttaccaaactggcaaacttgattggtaaggcaggttttacaattgccgcactgacttttatcgtttttaccagtaaagatttatatagttttatcacttcagaaaatttcattggcattaacgattggcattcatggctggagatagcacgtatcgtattgaagtacttcatgatggctgtcaccttaatcgttgtagcagtacctgaaggactgccaatgagcgtaaccctcagcctcgccctgaacatgagacgcatgctgaaaaccaacaacctggttcgaaagatgcacgcctgcgaaacaatgggtgccatcacagttatctgtaccgataaaacaggaacacttactcagaacctgatgcaggtatacgaagctcaggtagatgaaagccagcccgatctggtagcagaaggtatagctgctaactcgactgcattccttgaagaaaaggctgaaggcgaaaagccttcaggagtaggaaacccgacagaaatcgcccttttgctctggttgaacagcaaaggaaaggattacatgaaactacgcgaagaagccaaagtagtcaaccagttgaccttctcaactgaacgcaaatacatggctacattagtcgattcaccgattcagaagaaacggatactttacattaagggagctcccgaaatcgtcatgagcaaatgtaatctggaaaaggctcagatcgataaatataacgaacaattacttgcttatcagaataaagccatgcgtacactgggtatagcctacaaggttgtcccagaaaacgcttccgacgattgtgctgagttagtcggcgaaggtggaatgactttcttgggtatctttgcgatcagtgacccgattcgtccggatgtaccgaatgccgtaaagaaatgtcagtcggctggcatcggaatcaagattgtaacaggcgatactccgggaacagctacggagattgctcgtcagatcggactttggactccggaagatacagaacgtaaccgcatcacaggggtagaatttgcagcattgagtgacgaagaagcactcgaccgtgtactcgacctgaaagtaatgagccgtgctcgcccgatggacaaacagcgtctagtgcaattgttacagcaaaaaggagctgtcgtagccgttacaggtgatggaacaaacgacgcacctgccctgaaccacgcacaagttggcttgtcgatgggtaccgggacttctgtagctaaagaagctagcgatattaccttgttggatgattcattcaatagcattgcaacagctgtcatgtggggacgttcattgtataagaatatacagcgctttatcgtattccagctgaccatcaatgtagtggctctgctgagtgtcttgttaggtgctttcttcggaacagaattaccacttaccgttactcagatgctttgggtgaatctgatcatggatacatttgctgcaatggctcttgcttcgattgcaccaagcatggatgtaatgaatgagaaaccgcgtcgccgcaccgatttcatcattacaccggtcatgcgcaacacaattttcggagtgggcttaggcttcctcatcatcttaatgggattgctggtttactttaagaatctttcaggcggtatggatacacatcatcttactgtgttcttcaccatatttgtgatgcttcagttctggaacctgttcaatgctagtgttttcggtaccaaccattcattctttaaagatgcaggacacgcattaggcatgctgggtgttgcactgattattcttgtaggacaaatcatcatcgtaagctttggcggcaaagtattccgtaccgaacctcttccattgagtgaatggttatacatcataggaggaacttcattcgtcttgtggattggtgaaatatggagaggcatcaaacgcttgaaaagcaaataattcaatgccgtaaacattgggtatgacatgaatgaacaaataaaaaatatcatcttcgactggggaggcgtactgatagacctgaatctggaagggtgtatcagcgccttcgaacaggcgggagcagtcaatgtgcgtgacctgctgacaggtactaatgagctgggcttcttccgcgattatgagtgcgggaaaataagcacgcccgaatttcgtgaggctatacgtaaacatatcaataaaccgcttacggatgaggaaatagaccgcatgtggaatatggagctgcttaccattcctgaggaaaaactcctgttgctcgctgaactgagcaaacattaccggctatttttattgagtaatacgaacgaacttcactgggaatatggttacaagaatgcattctgccgtaacggtaaagactatacaatgtactttgagcgtattttcctgtcgtatcgcatgcacctgtcaaaacccgatcccgctattttccaaagagttttacaggaagccggtctccaaccagcagaaacattgttcatagacgatgcagagacaaattgtctggcagcagcctcaacaggcatgcaggctgctcactacataccgggaacagatctcggtgaattatttaaataaattcctacatgaagattataacagacgagattaagcaaatactttcaccttgcgtggcaaccatcggttgcttcgacggactacaccgtggccatcgtttccttatcgaacaggtttgcagagaagcccgccaaaggaacttccatagcgccctgataacctttcccgtgcatccacgtcaggtcatgcaaagtaattaccgccctcaatggcttacttgtctgccacaaaaaacaactcttatccagcaaacggaagcagattattgcatcatgcttccatttaccaaagaattgtccttgctctctgcacgccaattcatgcaactgcttcgtgaacgttttaacgtccgtgtgctggtcatcggctacgaccatcgcttcggtcataaccgcagcgaaggattcgacgattattgccaatatggaaaggaactggatatggaagtagttcgtgcacaagcattggtggaagaaggagtatccatcagctcgtctgtcatacgtaaagctttaaaggaaggagacatacagcatgccaatcattatctgggctatcgctattatctggatggaacagttgtcgacgggtataaagtaggtcgtaagctgggatttccaacagccaatctcctcccctcctgttccgacaaactgattcccaaagaaggtgtatatgctgtatatgccgacatcgacgggacacagtatgccggtatgttaaacatcggacatcgcccaaccgttgacaatggctccgacttaagtatcgaagtacatattcttaacttctctggagatatttataaccgtcacatgcggatagaatttattgaatttatccgccaagaacaaaagtttgacagtctggaacaactgattgcccaattgaatgccgatcgcgaaacaatatctcgcctgttattaaaaagttaaggaataaaacattcgagttctgttaagacaaaaaaatccccgacatcttttattcaaagaaatcggggattacaaaaaactatgataacagattacaattccttaatgctgatagctacaccaccgctcggagcaagacgctgtttcaacttcgttttgctggtcactttctttgtcgaaatcacatattctttgggatttgtacgccagtcggctgtttttccgtcagcataaatagttgcctgatatttctttccagccggaaggaaactcaaatcgataacagtttcccgactattctcatcggtaattccacccacataccattcgttctttccttttgccttacgagcaatcgtgatgtaatcacccggttccgcctccagaatataggtattgtcccagtccactgctacatccttaataaactgaaaagcatccggatatttttcataattctgatataaatcggctgccatctgaagcggactatacatcgttacatacaatgcaagctgttttaccaaggtagtacccaactgagccttgttagaaccataaacagaaagatcaccttcaaaaattcccggagtataatccatcggaccacccatcagacgggtaaacggcaagattgtctggtgatcaggacgaatgccattgaacgattcaaactccgtaccacgcgctgattcctgagcaatccagttgggatacgtacgatacatacccgtaggacgtacggcttcatgtgaatcaaccataatatgatacttcgcagccgtctcagctacccgattgtaatggttcaccatccactgtccgtcgtgatgttcactacgtgggatgatgggccctacgtaaccagtctttaccgcatcgtagccattttctttcataaaacggaacgcatcatgcatctgacgttcataatcggccaccgacgaagttgtttcatggtgcataataatttttactcctttcgatgcggcataacgttgcagttcctttacatcgaagtccggataagctttagtgaaactgtatataaattccttggcatgagcataattgtcttcccacccttcattccatccttccaccagcacggcatcaaaaccatttttcgctgcaaagtcaatatactcctttacatgggccgtattggcaccatgatgaccattcggtttcagttgggtatagtcagttttaccgattacgatgtcttgcgtatcggtataagcccaggtagagcctccgcccgtaaagtattcccaccatacacccacgtatttggtcggcttaatccaggaagtatcttccagtttgcaaggttcattcagatttactatcaagttcgaggccaagatatcacgtgcatcgtcgcttactacaatcgtacgccacggactggtactgccggtctggatatatcctttcgccccgtttttatcaggagtcaggtgcgaactcatcaaaaaagtctttgcatccagattcagatgcatagcaggataattaaccaaagccgcctcatggatgttgatataaagtccgtcatccgacttcagcatcaacggagtctgtacagctagattaggcgaaggtgacttgcaagccagggcctcatcgcgcgccttgtctatcagctgcggcacttccgacagtttggaagtcgttatctgaaactcattggtatcatagtcagctggaatccaaaatgccttatgatcgcctgccagctgaaactccgtcacttcctcattaatagtaaaatgccgtaattctttctgtaccggaaattcataacggaatcccaacccatcatcgaacaaacgaaaacgaatattcagcaaccaccccgtaccttcttgctccaaggctacaaatagttccttatgattatcccgaatgacactgttctgcccccaaacaggattccaggtagtatcggatgctgtttcctttgtttctatgatacggaagttcttactgaaatcgaacgacggacgtatctggaagcccatcttactttcccggataacatctttccctttatatttcaacgaataaaccggagtcttatcagccgacaagtgaaaatccatgattaaatttccattgggtgaagtcaatgtctgggcaaaagagaatcccacgacaaacaaactcatcattacagagagaattagttttttcataatacctttattgattaacaaaataaatacttttgtaaatataacaattatccgcaaatatacacttattccccttttgaaaacttctttatgccttcaagaaggctttctaaaagtattttcaatataaatcagaaaatatttattgtttttcgataaatatttcctgattttcttttgtactctaaaaataatatctacatttgcatatcgaaaaacgataaatatttatcgaaaacaaacacagataaaataattaagaaccacaaacacgatgcaattatgaaaaagacattactaaaaaaagcagctatggcaagcctcttcaccctgatgacactaacagtcacaaaggcaaacgcaaaagaaactttcatttatggagaaacagacaacgggttgattgtttctaccctgaatgaagacggcaaaacacttactccaaaatggaaatacgagtaccggtacgacgaacaaagacgactgaccgagaagaaagcatatcgatggaatttgcgacaacagatgtggacacccgcctatctgctcactattatgtcgaatgactcgatatgtatcatggattatgccgaatgggacaaacttttttgtaactttgagcgtaatcgccaacaaagtgtttattatgtagacagttcgaatgctttattgacttattatagccgttcatctgcctgcgaaataagtgaaaataacaaataattaaaattcaattattatgggacgcaccatcaaattattgctatactattttgcctaccaactggcattcatgggagttttcctgtgcggatatatgatcttccatcataccacagaattacctcaacccaccgactctacttacataaccctcattctgctggcacaggttctatctacagccgcggtaggtattcatctgatagtgggaaaatatgtaccgctcgaccgaaaaacttgggcgtattacaactccggtaaggtcctgattgccgctatcctattaatcgtaggtatggggttgtggagcaattacctgaacgaactcgccgacttgcccaataacatgcaggaaactttcgccatgatgatgcagcatccactgggaattgtggcaatcacgattatggcccctattgtagaagagctattgttccggggagccatccagggacacctgctgcgcaaatggaaaaagccgctctgggccatcgttgtatcatcactgatattcggtatcgtacatggaaactgggtacaagctccttttgctttcgtagtaggactggccctaggctggatctattatcatacaggtagtctgctccccggcatattgatgcacttcgtcaacaatagcactgccgttgtcagcttttggctttccgatgatccgaatgctacaatggtttccacctacggccccgaaggagctgcactcatggcggttgcgggagcgatactcactttcgtatgcatcaagtacatccaaagactgcttccacagcctgcaacatggagagaagaacaacccacaagtacaatcgaataataccccgaatttatgaaacacatcagcatattaggtatattggccatttttgccatagcactgaatatcttttttgccataggcagtaatctcaaagatttcaagcaaggctttgaagatggacaaaaggctggctctacttacggcacacaggcagattcacacgtattcagggcagaagtaagagttactcctatctccagtccaagcgatagtctgaatttgcaattacccggtgaaacagtaaaagtgccgtatcatgtttcaacaatcacctgtctgatcaaagagactccaaccatgttaatcaccataatattcgcagctttggcaaccatcgtattagcgacttatggtatctactgcctgatacgtgtacttatacgtatcacccgacaagatgtattctcccgacgtaatatctggtggctccgctggatagcttacggccagttagcagccatttcactctcgtacttgttaaactggagcatcgagcaggcagtccttgcacaagtatccctgccgggttatcaggtgataggtgtcaccccgatacccctgcaatgggatttagtcatcctgatcgtattacttacggaaatctttgccaaggccgtaaagattaaggaagagaacgacctaaccatttaactacatatcgcctatgaaaccgaaaagcaattattcacgcccgatggcagccatttacattattataagttttcttgccacactcatcgtattagaattgatttgcttcctcaccttttatccacttttggagaacaggtttctgcgtatatttgcaagcctaatatggctttatgccggagcttttgcttattataaaataacccaccgttataccaaatggtggaagagactaaacaacaaataaaacgtatgccgattatagtaaaccttgatgtgatgatggcaaaacgaaagatttcactgggagaacttgccgaaagaatcgaccttacccccgctaatctttccatcctgaaaacaggaaaagccaaagcagtccgattttctaccctggaggcaatctgtaaagcactcgattgccagccgggagatatattggaatacaggccggaagagtaaagctcttccggtaaaaggctgtcaaatagcaaagaataaacaactcttatagccgataatccattaattgtccgtatctttgcagccgaattagatatttgaaataaatgaagacatttgaagaactcggcgtttccgcagaaatacgccaggcaatcgaggaaatgggttacgaaaatcccatgcctgtacaagaagaagttataccgtatctgttaggaaaccgcaacgacgtagtggctctggcacaaaccggaaccggaaaaacagccgcatttggtctgccgctgatacaaaaaattgatgtaaagcatcgtataccacaagcactggtactttgtcctacacgagagctctgcttacagatagcaggcgatttgaccgattactctaaatacattaccgatttaaagattcttcccgtatacggaggctcttctattgaaagccagatacgcagtctgaaacaaggagtacatattattgttgctactccgggacgtttgatagacttgatggagcgcaaggtagcgcatctggaaacaatacgcgacgtagtaatggatgaagcggatgaaatgctgaacatgggatttaccgacagcatcaacgccattctggaacaagttcccgaagaccggaacactttgatgttctcggctaccatgagtccggaaatagcccgcatcgccaaaacgtatctgcatgatgccaaggaaattactatcggaacaaaaaacgaaggaagcaaaaacgtacatcacatcgcttacatcgtacatgcaaaagataaatacttggctttgaagcgagttgtagattattatccacaaatttacggtatcattttctgccgtacccgcaaggaaactcaggagatagccgacaagctgattcaggacggatacaatgccgattccttacatggcgaactgagtcaggcacagcgtgacctggtgatgcagaagttccgccagcgtcaccttcagctgctggtagctaccgatgtggcagcacgtggactggacgtaaacgatctgactcatgtcatcaattacggccttcccgatgatacggaaagctatacacaccgaagcggccgtaccggacgtgccggaaagactggtatttccattgccatcatcaacctgagggaaaaaggcaagatgcgtgagatagagcgtatcatcaacaagaaatttaccatcagtacactgcccagcggaaaggaaatctgcgaacagcagctcatcaaagtaatcgatgacatcgaaaaggtaaaagtcaacgaagaggaaatcgaagcattcctgccgggcatttaccgtaagctggaatggctgagcaaggaagaccttatcaagcgagtggtgtcgatggaattcaaccgcttcctggagtattataaaaatgcgccggaaatagaacagcccaaagcaagcgaaaagagcagcgagcccaaagagcggaaagaccgcggaagcgaccgtgaaaaagtggtacgcaaagccgaaaaaggctacgcccgactgttcctgaacttaggaaagacagatggtttctatgccaatcagatcattgaactgattaaccggaacctgaagaaagaacatatccagataggccgtattgacctgatgcagaatttctcctttttcgaggtagcagagaaccaggctctgatggtgttgaaagcgctgaacaaggtaacattgaacaaaggccgtaaggtgattgtagaaatggccggagaaaatacgggcaaaagcgacaagagcggaaagaaacgtggcaaggaaaacgtgaaggaagaaaaatcggccaagagaaaagaaacaaaagccgataagaaaaaggataagccgagccgtgaagagcgaggctatacagccgcacgtggtcctaagaagaaagacgactggaaacagttcttccagaacgacagccgccccctgcgtggtgaagagccagattttgcagaagaaggctgggccaaacgaagcaagcgcaaaaagtaatatccgttactgattgccttttatataccagaaattacatgaatcatcttttccgttgaccatgtaatttctggtttcttttttaagtccgtacgaaaaaaatactattccactaccagacgaagcttgcctgcaccggtacgcgcccgcagccattccatcattttctccctttcctgcttcgacggctgtttgttgcagtcgacaaatgcaaaggtaaccgtatccatgcggatactatctacattcaactgcaagctcttggatacagatatcgtttttacataagggaaaagaaccttaatctcctgccccatccgttcattcatcagattcgatccggtaaaatcgggcaagatacggttcaaggaatccagtgtcgcctgttgcgaagcaagttgtttttcactgttcttgtaaaagtcttccattaccaacgacttgatattgcttatatccatggagccagctccgttgacaccctgaaagaccgacaactttgtatcgttcaacttatactctgcaagtttatgacgtgccgcctgtaactggtcatccgatacttccttgcctatcaagaccacttttatctcccgtttgtcgaatgaaatctcccgactgagaacctgtgtatcggggaattgcaattcggacgtaatgaaactgttggccgaagactgataaatggtttcacgaacaatgttgtaagtcaggtaaacggccgggcacatggtagcaatcgcaatgccaatgatatacttacgcaccagcttttcgcgaaccttatcgacaaactgcttgcgttggaaatgcatcacccgcacgccgatgtaagtagccaaactgataaataccgaattaataaaataaagataaaaggctcccaggaaatagagcagattgcccgtagccagtccgaatccggctgtacaaaggggcggcatcaaggctgtagcgatagccactccgggtatcacgttacctttttctttcgttgccagtgccacaataccagccagaccacccaccagagcgatgaacacgtcataaatagtaggcgatgtacgcgccagcaattccgactgaacttcgtcgaggggagtaaacgcaaaatatattgtagcagtaattacactgaataaggtagcaaccagataactcttcaatgaacgtttcatcagttcaaagtcattcagccccacggcaagtcccacacccataataggacccatcagaggagaaatcaacatcgcaccgataatgacagcggtagaatttacattcaatcccaacgaagctatgaacgtcgcaaagataagaatccacagattggtacctttaaactccaccccgttacggatagactctacggttacctgttcatcttccttgctccggttcaagtccagatattcattaaagaatttcttgacaataaattttttgtctctttccataccattaaaagaaaggttactacttaacaaaacgattcacaaacggaatcgctttcaaaggtaaatcttttttcagaatataagctacgaaaaccaacaataatagcgtacggaatgccagtctccacactacatgctgaatggtcactacctgcgacagtataaataaaacagcagccagaatcaggtaaacgcccatctgcttcaacggataataaaccggatacttcttttgtccgatgaaataagacaagacagtaatcacaccatagccggcaaccgacgcccatgccgaagccacatacccgtatgttggtaccagccacacgttcaatgccagaatcactgcacagcctatcagcgaaaaataagcaccccactgcgtttcgtcggtcagcttataccagaaagacaggttaaagtaaatgcccttgaaaatttctgctcccatgacgatggctaccacactcagtccttcccagtaatcgcgcgccaccatgtaacgcagaatatccatatagcacatcacagccagaaaggccaacaacgaaaagatgaaaaaatacttcatggctgccgaatacatcttacgattatcgccctccttgttcttgccaaagacaaacggttcgtaagcgtagcggaaagcctgagtaaacattgccataatcatggcaaccttgctcgttgcactatagatacccaactgcaccagtccctcctgacggtcctcaaacaaaaaaggataaatcatcttgtcgatggtctggttcaatatacccaccaatccgaaaatcagaatcgggaaagaatacgaaatcatctgcttcatcagcggacggtctatacgataagagaagcctctcagttcgggaatgaagaagaacatctgcaccaccgacatgatcagattggctacgaaaatatagcctaccagatactccggacgatagaaccatgaaaccagctgatgtgcatgcacatccagccacggacacagcagcaggaaaaacaggttcagacagatatttcctacgatgttgaacagcttgatggatgcaaactttatcggacgcttcttgtagcgcaggtaagcaaacggaatgcactgaaacgaatcgagcgctacaaccagcaccatcatggcaatgtaatcaggatgatcgggatactccagcaaagcggagataggatgcagaaaaatcatacaaagcaccacaaagagcaacgacagccctcctacgaatatcaatgaattggcatataccttttccggctgttcgcccgacttgttggcgaaacggaaaaagcctgtttccataccgaacgtcagaagcaccagaataagtgccgtataggcatacacattcgaaaccactccatatccacctgtcgatgcaggaatcactgccgtataaagtggcaccagcagataattcaggaaacgccctacaatgctacttaacccgtaaattgccgtatcttttgctaacgatttcagtccagccataatttgtaaaaaaataaaagtgtgtgccgcagttatggcacacaccataattagtcatcaaaaagtgttttaacgttgttaaatctatttcttcccaaatgtttataagccagttccgtaacctcccgtccgcgtggggtacgcttcaggaaaccttctttgataaggaacggctcatacacttcctccaaggtcccgggatcctcacccagcgccgtagcgatagtagtcagtcccaccggcccgcctttgaacttatcgataatggtacacagtatcttgttgtctatctcatccagcccgtaacggtcaatattcagtgcctcgagggcatatcgggctatctccacatcgatgcgtccggaaccttttacctgagcaaaatcgcgtacccgacgcaacaaggcattggcaatacggggggttccacggctgcgcgaagcaatctctcccgccgcttccacatcgcacggaatacccaagataccggcagaacgcaggataatgcgcgacaaaaccgtatcgtcgtaatactccagatggagattgataccgaaacgcgcacgaagcggagccgtcagcagtccgcttcgggtagtagctcccaccagcgtaaacggattcaggtcgagctggatgctgcgtgccgacggacctttgtctatcataatgtcaatccggtaatcctccatggccgaatacaaatactcttccaccaccgggctcaaacgatgtatttcatcgataaacaagacatcattcggttctagactggtcagcactccggcaaggtctcccggcttatcgagtaccggtccggaagtcactttgaatcccactcccagctcgttggctataatattgctcagcgtcgtttttcccagtcccggaggtccgtgcagcagaacatgatccagtgcctcagcacggaggcgtgctgccttgacaaagatgcgcagattgtcgaccaccttgtcctgaccactgaagtcgccaaactgtaacggacgaagggcattttcaaaatccctctccttccctgttggcttataatcacgtatatcaaattgttcttccataatgatgcaaaagtacaaataaatcgtgtgaagaacgatataaaaaactttatctttgcaggaacaacaactaactttttacctcagacctatgaacacctatacaaccaatcatcttgttttcttctcgcctacccatacctcggcaaaaatagcacgagctatcggcgaaggtatcggtatgggacgaagaatcgaaaccgacttgactctcgatgaaagcgatactcctatcgaaataaatgactcgctgacggtcattgccgcaccggtatacggagggcgggtagcccctacagccctacaacgcatcaagcgcctgaaagggaacaattcaccagccatcgtcgtggtggtgtatggcaaccgcgattatgaagatgctctgctggagcttcgtgatactgccgtatcattaggattcactcccctggcagcaggagcctttatcggagagcacagttacagtacagccgaaatgcccgtagcagccggccgcccagacgacaaagacttgcaaattgccagccagtttggtaaagactgtctgaaaaagctggaagaagccgttgccagcatcggagagttgcagacgacaagcccttcccagcaaacggaacatacgcaacaaagtatcagtgctgaactatccagccgtatcagttccttctttgtaaaagggaatttcccctataaggtcgttccagcttcccagccgtcggctccggtttgtaatgagcattgttttgtctgtggaaaatgcgtggaagtatgtccgacccatgccatccgtatcagcgacgacggttcacacattgaaacagacattacacggtgcatccgctgttgcgcctgtgtaaaagaatgcccgaacgccgcacggacctattatagcccgttcactgccatcctgcacgagaaattcagtgcacgccgtgaacccgaacttttcttataaaagaacaaaaaaagaagcggatgccatcttaagagagatttataaaagacggtggcatccgctctaagatcctcttgcctaacctcacggccaagtcagctgacacctctcagtatgacttactgcaagatgcagccagaagagaataagaaagggaaaattattcaattatatgtgtgtgtctatttatacaacatattgccatttgaaatactactattctttagctcaacagtcttaaagttatgctttcatattgctaataacaatcataaatttgaatgcaaaaataggcaaaaatctgaaaacacaaaacaaattataagaaagtatagaaaaatactaaatatacaaatatcacataaaagagaatttaaacaacaaatatcacacatatcaataaaaatagctatcattttgatataaaatagataatatttaaagaaaacgatcgaacagagtgcaaagaaaatcattttacaaacgggaagttatatcatttttatttttacataaaagattaaaatactattaaacactaaaaaaacagatcaaatttcctatcctctatgatatacaaaaaacgttaaacgagtcgatatgcaatatttataagggaagattccatatgtattaataaaggatttatgtttttatacttacttttgccagaaacaaatggcagaaactttttaccatgaataaagaaaagcgaatactggtaggcatgagtggaggaatagacagttccgctacctgcatcatgctgcaagagcagggctacgaagtagtaggtgtaaccatgagaacctgggacattccttcccatttctctactcccggacaagaacagcccgacgaagtactggaagctcaggcactggcagaacgattaggtatagagcaccatgtagccgatgtccgcaaagaatttaaagatgtaattgtccggtatttcatcgacgaatatatgagagggcgtactccgaatccctgcgtcatgtgtaatccgctgttcaaggaacgcatactttgcgaatgggccgaccggaccggatgtgcacagattgccactggccattattgccgactggaagaccggaacggacaccgttatatcgttaccggcgatgacgccacaaaagaccagtcatactttctttggaaactgccgcaggaaatattaaagcggatggtattcccgttgggaggaatgaccaaggcagaagtgcgtgattatcttgccagcaaaggctttgaggcaaaagcccgtggaggggaaagtatggaaatctgcttcatcgacaaagactaccgggagttcctgagagaacattgcccggacatcgaccagcgtatcggtccgggatggtttgtcgacagcaaaggtttaaaactaggacagcacaaaggatttgcctattataccatcgggcaacggaaaggactggaaatcgccctcggacatccggcgtacgtactcaagatcaatccagccaaaaacaccgtcatgctgggcgacgcagaacaactgaaagctgaatacatgctggtagaagacatcaacgtaatagacatgaaagagctattggaatgtccgaacttatctgtacgtatccgctaccgcagccgccccatcccttgtcgcattgcactgctcgacgacacacacctattggtgaagttcgaagcggaagcatcggctatcactccgggacagtccgccgtattctacgacggtggaagagtattgggtggaggatttatcgcctttcagcaagctatcaaaaaattagccgccgagaataaagaaaaattttagccgttttagcccttcacccccttcacaatacggcaacaacaaggctaccgtcggaaggagaatcccttcatttatcacaagcgtgaaggatgtggagggtaaaacatgtgacatcataaaaaaatatcgggagattcagtaaaaaacctcccgatatttttttagaatttgtacaaaagaaaaagttttttgtacaaaaacaaatcctttttctacgtcaacgatacgaatcggcaaactctttcgaaacagagttgcttacacttttgcagacatccgcactgaaatccattccacagcgaataatcgcatcccagtcgttttcgctcaactctgccaagtcagcccgacgaacacggtatttcaacagtccgtacacgactccggcattaaaattatcgccggcacctatcgtactgactgctttcagtggagtaaccggataattcttgcatacatttttcgtacgcaagcgcacatctccacctgcatcggtgcaaataaagttcggacaataaaatgcaacatggttctgataaaccttatcagcatccgtctggcggaacatattctggaaatcctcggtcgagcctctcagaatatccgtatactcaaagttctcaatgatggtaggcatcagcttgatcgcctcattgacatgcgtactgcggaagttcacatcgtaataaataatggctcccgcctcatgtgccttgtcgagcaactcctttaccttgtcgcgcaacacaggtgtaatggcaaaatacgaaccaatcatgatgatatcgtcagccgacacgtcgggcatattcacatccagtctctgacggggataatctttatagaagatatattcggcatcattgttttcattcagaaaagccagcgatacaggcgattttccttccgggaatacatttacattcgccgtatctactccattgttgcgcatgttagccaaaatcatctctcctacacggtcgtttcccgtttcactgataaaagtaacattctgccccattcttcccagcgagatcatggcattatacaccgaaccacccggcacagcagcttccggttgtccgtcgcggaaaagaatgtcaagaatcgtttctccaataccgataacctttctcataaatcactccttatatattatttgctcaatgcccgggagcgttcacccagatagcccccatgatggcgtttactatattcttcgatggtaaatccggtctgcttcatggtttctaccaccagaatatcgccgataacggtcattacggtagtagaagtcgtaggagtcatacccagcggacaaacctcgtccggatgtccggtaggcagacagatatccgccgccttggcaagcgggctgtccggattcccggtgatgacaatctttttcaacgacggattcagacggcgcgccagttcagtcagctctacaatctcacgcgtctttccagagttggaaatcagaagcagcagatcattctcctgcaaaatacctaagtcgccgtgttgtgcttcactcggatgaagaaatacggaaggaatacccgtagagcagaaagtagtagcaatattcatagcaatctgtcctgcttttcccatcccgctggttacgagcttacctttcttgcaatgcacttgttctacaatcagtgccaccgccttttcgtaagcatccgttacaggaatgttcaatacagcctgcgcctcgcgctgtaacagttcgtgaatagatgaaatcatatgtaagatatttaatgttttaataattaagaattcagtaattgtgtcagctcgtcgaatgtatttgccacggcaaaatagttcttcaacggacgatgcgcgaaatgctgtgtctccagccctgaaaggaaatcgagaattccgttccagaacccattcacattatagaaaatcactttcttctcgtgatagcctatcgtggcagaagccatgacgtgaaaaatttcatccagtgtacctacccctccaggcaaggctaccgccacatctgcctcctgcaacataatatctttccggtcgctcaagttgactgcccggaacgttacatcaagcaaatcgcttaccgcacctctctcttccagcttggtaggaactactcccataatcatggcaccattctccttagccgcacgggcaaccgcttccatcagtccggtattcgaacctccgtatatcagccatttgcctgtctgtcccagccaggtacccagttcggcagccttttcagcgtaaaccgcatcaatgtgatcggacgcagaacagaatatcgcaattttattcataatgtattactttaagccacacagccagattggcacaatcttactcgatgactgtgcaaccggcagtgggagaatcaatattcttgcaaatatccgtatttttttcagttactacaataagtattattgtatttttgcacccaaaatcaattcaaagaagaaaacttatgccatacaatacttttatcctacccaacggactgcgtatcattcataccccaagcatgaccaacgtgacttattgtggttttgccgtcgatgccggtacgcgcgacgaactccccgatgagcagggtatggcacattttgtagaacaccttatatttaaaggtacccgcaagcgacgggcatggcacatcttgaaccgcatggaaaatgtgggtggcgacctgaatgcctatactaataaggaggaaaccgtgatatacagcgcttttctgaaagagcattttgcccgcgccgtagagctattgaccgacattgttttccacagcactttccccgagcacgaaatagccaaggaagtagaagtcatcatcgacgagatacaaagttacgaagacagtccggcagaactgatattcgacgattttgaggaacttatcttccccgaacatccattaggccgcaacattttagggaaaccggaacagcttcgccgtttcggaagtcaggatgccctccgctttactggcagatactaccgacctgccaacatggttttcttcgtacaaagcgacatcgatttcaaacgtattgtccgcacagtagaaaaagccatggcagaaattccgttttctgcagtagaaggttaccaacggcaagcccctctgccctatcagccccaacagcttacactgcacaaagatacccatcaggcccacgtcatgatcggcggacgcggatacaatgcatacgatgaacgccgaacaggtctctaccttcttaataatatactgggaggccccggcatgaacagccggctgaatgtatcgcttcgcgaaaaacgcggtctggtatataccgtagaatcgaacttgacggcttataccgataccggtactttttgtatttatttcggctgcgatcaggaagatgccgactactgcgccgagctggtacataaagagctgagaaagctacgcgaccatgccctgacttcttcacagcttcatgctgccaaaaaacaaatcatcggacaaatcggtgtagcaagcgacaacttcgagaacaatgcgctcgacatggccaaatgctttctccattacaaacgttacgaagaaaaagaagaagtgtttcagcgcatcgaatcactgacagctacggaacttttgaaaatagcaaacgaaatgttttccgaaaattacctgtctacactaatatacaaataaaacaaacatgtaaaaatttgtctatttatcaatttaacttacattttttgacaaatcaaacatatttgacaaataaaaatttttgtcattcatacatatttcttaaatttaccccataattaatgttaacagattttatttgtctgtaaagtatattatggaggacaacgtatttatattagagattacttcggggatatgctgcatattgacggcaatattcctacattactctgctatccccaagggcagcaataagaaaaactatcaaaaaggatataatttagtaaaattagcctctcttatattaggaatagccgctttgacctttgcaataacaggaggtccaacacagatatatggcaaaagtaatttcatccacctaattctgccagtagaaacattgctaatattttgggtatttatatatccaatttacgaaaaagaaaaactaaaaaacttcctcaagcatcaagtcttttacacatcattactcttttcagccaatgctatctacatatttgtagcccatggagggcccggcgagtggttttactatatattagtatcttgttacgtaatacaatttgtcttttatacaattatttatatacacatcaccaaaatttggctaagagggaaaatctgggaaacaggcaacttaaagaaatatcctctccgtacatgggcgtcgggtttcatcatatgtataatgggaatcatagcagaaatttttccaaaccctatttacctgcagatattcaccttatgctacaccatattctttatttcattaggcatacagtatcataattatagcataatatctctaaatgagcaagttaccaaagaatccgggatatcccctgcaaacaaggtagaacagcctcatcctgaagaaaaacgacatggacagaacaacgatatcatcagagaaaaactcagggcatgggaacaaaacaaaggatatatgaaattgggaattaccattcaagacctaagtcgtgaaataggtataaaccgtacatatttgtcaaattacataaacgaaacctatcagacaaactttaacggatggataaacgacttacgcatagaagaggcgaaacagaaaatcatgcaatcccctgaaattaacctaagtgacttggcagaagccgtaggatttgccgatcaggcacacttcagtaagcaatttaaacaaaaagaaggtatccccccttctatctggaagaaagagcatcgccctccaaaggaaaagatataaattttacacttttgtcaaaaaatacacaattatatacaaatagacaagcagtagcgctgtttttagggttagatttgcaaaacaaataaaaaagcgaaaagaataataaagaacattatcaattatcattcattaatttttaaaagtatgaagaaaaaattctatggagccctcgtattaggaagcgtgcttcttgcagggggaatggtatcttgctctgattacgatgatgacattgatagcttgaacaaccgtgttgcagctgtagaacagactgtaaaggaacttcaagataaaatcaatgcaggagctgtaatcacaagtgtcgacccgactgaaaatggggtaaaagtaacattgagcaacggcgaatcatttgaattgcaaaatggagctccaggtgcagctgctactattgaaattggaagcaacggtaactggtttatcaatggcgtagacactggcaaaccatctaagggtgacaaaggagatcaaggtgacccgggaaaagatggaacatcagctacaggtaaatactacaaaccaggagaaaatggatactggattgaagtaactgtaggtacagacggtaaagaaactgaaacagaaacaactatcagctggacaccagaaggaacaatgacagctgcatgggactctgaaaacgggaaattgatggtaagcaacgttaaaggatataatggtatcttaactatcaatttaacgtctgaattaaaatctttagtattcgtacctgacttctactatgaaggaatcgaagctatggaagctagaactttcaactacacagaaaaaacagttcaaaaagttgaagctaacaaggattattcaacagatgcacctatagaaaaagatggcgttgcaatgagtccaggagttgtggccgaataccacatgaatccgtcttccgctaattggaaagatattaaatcactgagttaccttactgctgataagaactatactagagcaaatggaacagtcagtgcaaatgtttttgattgggaaggaaaagatggtattttaacggttcattctcaattaacagatggcactatcaaagatataagcaagggccaagttacagttttagcattacaagccaattattctggaagcgagaaagatacaatcatcacttctgactatgccgcagtgaaagctacagactataatatcgtagcattagctcattcttcagtaaatggtgctactgaacacacagaacacttatatacaacagctgaagaagctattaagaatgctgcaagccatgaaattgtatataatcatacaggtttggatgtagctacattggttcagacccattataccactccaacagaaaaagatgttgaatgggataaaaacgctactgtaggagaagtagagaaatatggctttaaatatagctttgaacttgtaggttaccatgtaggtgacaacaacacttcagaaagtgctcatgctgtcatgcaaggttcattgttaaagccatgtatgcctgttaacggacagcaaccgacatgggatgctgctacgcaaaacaaagcagaaaaagatcgtgaaccattggttcgtgttatcttgactgatacaatcagcaataaaatagctgctgtaggttacttaaaatttaaaattgttgaaaaagcaactcctgtacagagtgaagttatcttgacacctagctttgactttaaagataattacactgtagattgttcagataaagcaatgactctgaagatcgaatggcatgactttgaagaagatatccttgctcctctgcttgaaaaacaaggtatttctaaagcagatttccacgataacttcaaattggagggtggtgaaactaatgcaactcaatttgacggaatagaagctacatctcaaccaacaactaagaaaggtatcgtagcacagactacaacagataacggtgatgaagaaactcaggttatcacttggacattgaagaataatgaagcttatcagttgtttaagaataacgcgtctatttcagtaaatatccgttacagcaaagaagtaacagctggtgtatatcagtatgtctacatcacattgacttgggaacctgaacatcgtaatgtacaaccttcaggaactataaataatactgataagattaagaattattggtatgcttataacgcagcaactcccggacaaggagtatacgatgaaattcatgctaacgttgaaactgtaggtgagaaatatactcaaccagacggaaatgagacggaggcagaggataacttcaaatccgatatcttaaatacatttgaaggtaacaatgttacagtttcagttaatgatgccgagacttacaccgcattcacagatgctttattagagaaaacatttacatttgtagatccacaagatagtaaaatgacaccggtaaagggtaactctggtacaatgtatgacatcacagttagtgcagatggtaagacattgaatgcaaatgtagtaggcaatcctcttgtaatacaaccagtagttgttcttaatggctcagttctggaatatcaaggaaaagatgataatgcaaactattcttttgctagagatattttaaatgcagctgaccacgcacaatttacagcggactcagagggcaagaagacatttactgcacaaatccaaatcaatgcagaaaattgtgattatgtaccattcgaccttagcaacaatacattctttgctaagttcttacgtccgattacaatcagtgatacacatgaaacaaactttgtagacgctacaacaggtggtgccacagcggatttgaaactgtcattcactgattggcgtgatcataactttgatgatgcaactgctaccaaaggtcagaattattatgcatattatgatgttgaatcaatcgaacagaacggcgatattctaactgacttgaacggagaagatggtgtatttgatagaaagttaagtgatgtaacaggaaatgtgaaatttacatttaaagctccgacagaagcccaaattcaaaatgctcagaaccactactttggtacattgacatacttgaataatggtacaacagtaggtaaattcaaaattaaagttccatttgatgttacatacgattggggtacaatccgcgtatgggtaatatgtaatatttctcagactgaagctaactaagcataagcctagatttctataaacaataaaagtaaggggctcaaagccccttactttttatatcaaaaagacaaaaaatgaaaaaattaaatatcattgcaatagcaatttgtctattaagttttttttcatgtcaatcagctgataaagaaaagcaaaaagattcaaacactactgaattaaacagttttgtaagtggactcgtaaaagaagatacaatagcagtagaaaaattagtaaattcctatatgacctacgcacaaaaccaacaatatgctgaagctgcagcaatgttatataagccagatacggcagatatatggaatgaacctgtgcctttaaataatgatgaaatggaaacggtaaaaactgtacttaaaagtttcccagttcacagttacaaaataacagaaataaaattcaacactgcagtagataatgaagtaagatgctccttcgttatgaacgaatcatcgaatataacgagcagttggacattcagactcatgaattatttaggaggctggcgactttgtctcatgaaatgacccttatattatagcgataatgtaaatcccccttgcaaattatactaaaataagtcaatgatttaacattttaaatatctacacttatgcattggaataattttttaacagtattagtaattgggcttgcaccagttactgcttactcacaaacgacacaatctgcaacagaaggaaaaacagaatttgttcctcactggtttatgcaagtacaagccggtgccgcacacacccgtggtgaagctaaatttggagatttgatttctccagcagctgctatctacggtggttatcagtttacaccgctttggggactacgtgctggaataagtggctggcaggctaaagggggatgggctgccgacaatcagatttacaagtacaattacttgcaaggaaatgtagatgctacattggatttgagcaatttgttctgccgctataatcctgatcgtttcttcaatgcatacttgttcgcaggtgtcggcctgaatggagcgttcaacaacgatgaagctgttgcgttagccaacaaaggctatgaactgcgttacttatggaaggataataagatcagtccggtaggtagattcggattaggtactaacctgcgactgacttctcatctcttcttcaatattgaggtaaatgccaatgtgctatcggataagtttaattcgaagaaggctggcaatgcagactggcagtttaacgctctggccggatttactattaagttcggaaagacttcgcgtaaaacagagcctgtatactatgacccgactccgcaaccggcacctcctgtaaaggaagaacccaaaccggtacaggaaccggctccagtaaaacaggaaaaggtcagcatgacagaaaatgtcttctttgctatcaactcgtctaagatacgtacatcagaagaacagaagattgaaaagctggcagaattcatgaagaatcatgcggactgcaaggttacgatctgtggttatgcagacaagcaaacaggtaatgcaaaaatcaacgaacgcctttctaaggaacgtgcagaagctgttgctgctatgctgaaagaaaaaggcatcgacagtcagcgcatcgtaatagatcataaaggtgatacggtacagccatttagtacaatggaggaaaaccgtgtaagtatctgtattgctgaataaacagaaccctttaattcttcataacacgaaaaggagtgtcgctctcccttccccctgggagatgatgacactcctttttattttttatcgaacaggctaaagtttgtctatctcatctttggatagtccggttacctgagaaatgatttcatgatccaatcccgccagcttcatgctccgagcattggctatgttctgttccatacggcctttagctataccttccgccatacctttagccatacctttctgttcggctgtcactattgtattctgccagtcacgatacaccttgaggctttcttcgtaggcctcatactgctcctttgtgaatttggcgatctcggcagcctcgaacagacgggtaaaaattcggtcctgaagggcagcaggacgtgccatcagacgggaaagatttcgaaggacgaaaagccacttgtcgaacatcgtcacaagctcgtcctccgacttgttgaacttgggcatttccagatagatgaacgtgagcttgtcgtaaaacacctgcttggtgcatacatccatcagctggacctcatggtggaagtaattgtcgtcttccgagtcgaacttgaaattcagaataccgattacataaaccgctttcaagcgatagtcccactcccctttctcaccctgctcgcggatgggaaatgtggcgtaataaaggctacggtccttgaagaactgctgctcgccacgctgcatctctatcagaatcttctcgccgcgttcgttctcacagtaaacatcgaagacggcacgccggtctgcctccgaagtgcccagatgttccgtattcaggtaagtcaggtcgcggatcacttccttgccgctcagcaggctgttgataaaacttatcaaaagttccttgttcatctccgtaccgaaaagcatcttaaaaccgaaatcggtatacggattgatgtatcggtctctaaatattctgtttgacataaacttatcggttgatctgacacaaaagaatcaaaaaaaaaacatttttccaaatgtaactgtccttttcagttgtgaagaatccataacaaaccaaagagatgatctatttgcattgcaacaaagacacagccaattgtttttcccggaaaaattagtacctttgcccgagaaagtatctaataacaaacgcactaagctatacacatgaaaatagaagataaactgactgcctccgtcatcaacggggtaaaagaattgtacggtgcagaagttcctgcaaaaatggtgcagctacagaagactaaaaaagagtttgaaggtcatcttacgctcgttgtctttccttttctgaaaatgtcgaaaaaaggtccggaacagactgcacaggaaatcggcgaatacctgaaacagcacgaaccggctattgccagctataatgtaatcaaagggttcttgaacctgactatcgcatcggatgtatgggtagaactgctgaaccgtattcacgctgatgcacaatggggtatacaaaaggctgcggaagatgcgccgctggtaatgatagaatattcttctcctaacacaaataaaccgctccacctgggacatgtccgcaataacttgctgggtaatgcgcttgccaacattatggctgccaacggaaacaaggttgtaaagacaaacattgtaaacgaccgtggtattcatatctgcaaatccatgctggcgtggctgaaatatggtaacggcgaaactcccgaatcatctggcaagaaaggtgaccacctgataggtgattattatgtagctttcgacaagcattataaggctgaagtagctgaactgatggaaaaaggtctgagcaaggaggaagctgaagctcagtcaccgctgatgcaggaagcacgtgagatgctccgtaaatgggaagcaaacgatccggaggtccgtgcgttgtggaagaagatgaacgactgggtttatgcaggattcgatgaaacctacaagatgatgggtgtcagcttcgataagatatactacgaatcggaaacttatctggaaggtaagaaaaaggtactggaaggactggaaaagggacttttctaccgcaaggaagatggttctgtatgggctgatctgactccggaaggtttggatcataagctgttgctgcgtggcgacggtacttctgtctacatgactcaggatatcggtactgccaagctccgcttccaggatttcccgatcaacaagatgatttatgtagtaggaaacgaacagaattatcacttccaggtactttctattctgctcgacaagctgggattcgaatggggcaaggatctggttcacttctcttacggtatggtagaactgccggaaggtaagatgaagagccgtgaaggtacggttgtcgatgctgacgacttgatggaggctatgatagaaacagctaaggaaaccagcagtgaactgggcaagctggatggcctgactcaggaagaagcaaacgatatcgcacgtattgttggtctgggtgcattgaaatacttcattctgaaagtggatgcccgcaagaacatgacattcaatccgaaagaatctatcgatttcaacggaaatacaggtccgtttatccagtacacgtacgcacgtatccagtcaatcttgcgtaaagcagccgaagcaggtatcaccattccggccgttattcctaccggtgtggaactgagcaccaaagaagaaggactgattcagatgcttgccgactttacaaatgtagtgcgtcaggctggcagtgattacaatccgtctattctcgccaactatgcttacgagctggtgaaagaatacaaccagttctaccacgatttcagcatcctgcgcgaagaaaatgaggcgttgaagatattccgccttgcattgagccagaatgttggaaaagtcgttaaactggctatgggactgctgggtattgaagttcctgaacgtatgtaatcagaaaacggaacaatcaatcatatagtttttcattcaccacgggttatacagaccgctgcacgttaatacgtgaaactctgcgtaacctgtggtgatttggtttataacatattctcactaaaaatctatggcaaagcagcaaaaattttatgtagtatggaaaggcgtggaaccggggatatattcttcgtggactgactgccagttgcagattaaaaactacaaaggagcaatatataagtctttctctacccgtgaagaagcagagcatgcttttgccactccggcgcatcattacctgaaaggaagccgttcacaagcaagtgaaccggcagagaaaaaaatccctgaaaacttcgacttgaactgtcttgccgtagacgcggcttgcagcgggaatccgggaccgatggaatacagaggggtatatctgctgaccggacaggaaatatttcacttcggaccgatgtatggtacaaataatatcggagagtttcttgccatcgtacacggactggcactgatgaaacagaaaggtatcaatatgcctatctattccgacagccgtaatgcactgaactgggttaaacagaagaaatgcaagacgaagctcgagcgtacggagaaaacagaaaaattattccagctcatagaacgggcagagaagtggttgcatgagaaccaatatacgactcccctgctcaaatgggaaacagatagctggggagaggtcccggcagactttggcaggaagtaatttctgcctcatcaaacggcctgtctgcgcctcagataatgcgcataccggggataatttcttctcaggtatcttaatgcctttcgccatagtttctggctgagcaggaaaagtaaaaagatagtacctactatacacacagcaccaaacagctccttcagactcgttaaaagtgtctgatgggttacttctgcgtaaagctgctgaatggaaacattgggcatccattctttgaccagatcaacctgacggctcagcaaaccgatattatcttgctgcatgtatttcaaccaacgattcaagatggctgtaccgagaggagtagcaatactggtacggataaaactcagcacacacagtccctgaaaaaaatgtttgaacggaacagtcttggctacataaatcgtcagcgaaatatacagaatgccatgtcccagtccttttaggaaattaggtatataaaaactttcgatattcaaattaggatcgatcaagaaatacatgtagtactgatagaccacaatcagcatgaaacctacggtaatcaacagtttatatcctttccgcagaataacctgacggtagaaaacaactccagcacctgccagtataccgataaagacgcaccagttaatggacacggcattcaaggcatcatatttcaagacagtccgcataaacatttcctgcaaaacggatgaggtcgtaagaaacaggcacaacatcagaaaaaggaaaagaatagtcgggaaatgacgatacttgaaaacgtgaggatcgatataaggatgacgacaggtagtcatacgattgatattaatcattacagctatcactgccactacgatacaactacgaatcaacggactatccagccagtcgtaatattctccgtagatacaaacaaacacaatggagaacaatacaactccccacagaatacctcctatccagtcaataccgtacaggggcatcttttttgcaatacgaaacggtctggtaagaaagaatacacagaaccataccactgcaagcagaccaataaccagccagtgcatgtactgccagttcgcccagtcgctgatatgtgtagctactaatcctgaaagctgaatgctttcgagtacgatgatatagatgacaggataaaagaccgagaaatttccggaaggagtaacactcagacgaatgttcgaaaagcattcaaaggttccccacatacggaagaatccggaaacaaaacatgtgacaaccagtacaaagatgtttccggtatgcatcgttatcagattgcaacaaataagtaccggacatactgtaagaaagatacgacgggtggtgaaacggaacttcagacggaacaggatagggaaaataagcgtcatacctatgaaggaggcatatcctgccatcatcacatcttccttgaggcatcctaatgcgctcgacatctgtacggaagtgggaagaaatactcccccgttgaactgaaagatcaatgcaaaaaacatggaaagaagtacgcacaacggggtcggaaggtattctttaaaatacaagattcttggacgctgctctgctgccatatctacgttctccttactgtagttttacgtaacattctacgttcattccggcacgcagacggttcagattctctttactgttgttttcggtaaattcgatgcggaccggtattcgctgttctaccttgacaaagtttccggccgaattatcctgaggtatcaatgaatagaatgagcctgtagcatccgatatagatacgatacgtccttcgtaagtgactcctggaatggcatccacattcatttcaacacgctggccttgtctcatatctgtggtctgtgtttccttatagttggctatcacccatttctctgtaccatctaccagcgtaaccagtgtctgtcctgactgaaccaactcgccttcgtgaatattcttacgaccggtcacgccgtcggctgtagcacaaattactgtatacgacaagttcagcttggccagattcaaggcggcttctgccagcttgatatccgattcattctgctccagacgctgtgtctgctcctgttttaccagctccgacgattctttctggcgaaccagctgttcatatttggctttcgttgcagcataatcggtctttacacgatcgaactgctggggagttacagcctcttctttcatcagttcggcataacgcttgtaatcggtttctgcattctgaaggcgtacacgctgctcttcgatagctgcctcggtaacgtagatattgctctgtgtcgtattgatagtggtatgcatggcactttttcctgccagtgcattctggtagtcagcctcagcctgagccaccttcaacagatactctgtgttttctattaccaccagggtatctcctttcttcacagactgatattcctcaaaatagattttcttgatgaagccctgtacacgggtattaatcggactcaaatgctgcttgatctgtgcattatccgtatattctacatcgcccagatgaatgaattttccacatacccagctgatgcctcccgccagtaccaatgcaataaaaaaattcgggatagctcttcttttattttttatcataacgtcttcctttatttattatagctttatcagagatttccagttagttttttcaataaataatactgatacaagatacctatctggtagtttgccaactgcaattccatatccaactgcgtattgctggcatccagcatgtcggtaatcagtgccagtccgttcacataccgttgacgcacaatattgaagttctcatgtgccaactgtacgctctttttctgcgtacgcaaacgtatgtatgcctcattcagattgacataggccgcatgaatgttattttctgcttcttcttccgccagactgcgtgcctgctccatttttcgggttgccagttgtgcctgcttcagcttctttttactcttaaacaaagcatcgatattatacgaaatgcctacaccggcataccagtaggtgaagttgttgttcaatggaggaacctcgaccagaataggaccggtaaaatcgtttgccgcaaccagactgattttcggccttctctcggcacgaatcagctccagcttattcttttcctggctaatctttacatctgccagcttgagcgacggggtatgaggtatctcctgcatccattcggcttcttccctatgctcaacattgattttcagcaattcggttgtatcggggagaatcagcacaccaggctcaagaccgatagctgttgccaacttatggctcagcacatcaatcttatccttgacggaagtcaacgaaagctccagactctgaagctgaagttcgtaacgagtaatatcgcttttcaaagctgttccctgacgataagatgccctcatatcctttaccagcaaacgagtctgtgaaatattgctttcatacacacgtttctgattgttcagctggaaaagatccagataatatcccgtcagaagaaaacggatatcctgacgatttcctgcatattccagctctgcctgccgctgctgtaacttgctccgctctatcccattcgttattgctcctccggcataaaccacctgacttgcctttacgacaaaagaattgccgaaatgaggcatatcagcatgaaccgcattggaaaaatttctatcggtcatcactccgtcgcctatgtacttaaaatccatctgcgcctgaatggatggcaagcgatcgttgcaagctacctttactgcctgttctgcttcagatatggccagatcatacaaccgaatgctcttgttgtgctgatcggccagctgaaacatttcatcgactgtcaacgaacgagtctgggctgacacactccccaataaacctaaaaaaacaacactaactaataatactttttttatcatacacttgtttagcctttatgtaattgataccagacaactaaattctcattcctgtatctggtgcctgcaaagaaatcactatttccctgcatccttcaggttctcttcgaaccagctgactactttttctataacaggacgttggtaccaataaaggtcaccatgtcctgcaccctctaccacaatataattaactttattccctttctttaccagctcattatacagctgttcactttgcaccggcgataccagctggtcgttcgatccatgcataatgagaaaaggaggcataccctctttcacatgtcccatcggactagcctccattgctttctgcggatcactcaatatactctttcctgcaaaatcggcaaaggccggtccatatagcagcaaggcctctgttacggctggtgaagcatgtatgtcttgtatctccttggaataaccttcaccgatattcatcagattgctgataccataaatggtaacagcagcctgtacgtcagaggactggtcaagattatctccctgatcaaattgtttttcaccattggtcgttcccatcatctgagcgacataccctccggcagaatcgccaagcactccgatacgggatgcatcgatacctagttccccggcatgtgcacgcaaaaaacgtacagcagcctttgcgtccacgaccaatgccggatacttgtccggtacaacgcgatattcggcagcagcaactacaaaaccagcctttgccagtgccatacgcatttcaaaatatcgttcgtgggcagccgaagtaaatcctccgcccgggtagaaaacaaccgcaggcttcagctccttggtacgtggaatcagcaatgtcattttcaacgcacgattggcgcgcagcgaaggtgtctgagaatatactaccccactgataacatcaatctgaccttccgtaatttttactttcaagacttccttgccttcagcctgagaagcatcgtttgtcacaggagaggctgccaatgaaatgcccatactacaagcgatgagcatacaaacaaatctgatcatatatccagctttcattttattgttcaaaataaattatatccgagttttcataaaatagatacatgtgtaaaatagatacatgtgtaagatagaacatgtgtaaggtcgcacaaaaagttggatgagagtgcttttccggtgtaatgccgataatttataatcatatttattttgtcatgcaaaagtaagcttttatttttgctccgaatttacacattacgcaacaatattaccaatatacgccaaaagcgaaccatgaatacagagcaacaagaatatatatcactgataaaccgttcggcaccagacgacattcttatcaagaaaaccggatgggaagaaatcaacttgcagggacatgctcacaagaaattccagattatttacaccctgtccggtacactccacgtagaaaccgaaggagctaattatttcgtacccgaaaagcatatcgcatggattcccgaaaatgccagccataagttgtccagcaacagccggcaggtttcgcttatcatcttctatgtaactctgaacgtgacacccgatgacagcaaaagccgtttttcgatatacagcaccaacgctatcatcgcggaaaatatgaaatttatcgcttcaaaagggaaactgataacccaaaaagaacagcccgatctatacaacttcacgctgagcttctttaatctgcttccacaaatgtcgcccggggccgatgtactgctgaaaacacttgttatccccaacgactcccgactacatcccatactggactacattgtggaacacatccacgaagagctgaacatggaacagattgcatcacaatacaatctgtccgtacgcaatctgagccggttgtttcatacctcagggcttcatttcagcagctacgtgaatcacctgcgaattacacgggccatcgaactgctgaccgacggagaatatacggtacaggaaatcgcctataaggtaggatttaatactcccaacaacttcaacagagtattcaagcagattacaggcaagtcgcccaaagcatacattacgggagtctgaaaagcaaatataaccaaaagccagagtacaaacaccaagatggcttagccgacaagccaaaaatatgtatctttgccttattaaacttaagaatatatgaaaaaaagaatcgcctatctggtattgttcttcgcaatcatgctcttgttcttcgtgttgcagaaaccatgcttcatgctttacaatgacgctcccggaagagcagttccgtttgttggctacctgcaggtcatgctgcacggaataagcctcgatgccgcaaccacaggttacctgacagcccttccatggctcacgatactcatcagcatctggtttaagaaatttccgttacggagcatactgaccggatactataccgtaatctgcctgctagtatcactcatctttgtaggtgacatgtgcctttacccgttctggaacttcaagctcgatgcttccatcttcttatacctggactctcccaagaacgccatggcaagcgtttctatcggattcattctgctgagaatacttattatcatcttgctttccggctttcttacatggatattgtacaaggttactccccgacacctgccacccgcacaatggagaatagccggaagtattgctaccctgctgctgggcggagtactgtttatcatcattcggggtggagtaagtgaatcgacctcaaacatcggacaggtatatttctgcaacgatgaatttctgaaccattctgccgtcaatccagctttcagcctgatagcttcaaccggaaaaaccaagaactatgccgaacagttcaatttcttcgatgaaatgcatcggaaggaattattcgataacttataccctaccggaggaaaaaataccatagaactgctcaacaccaaacgtccgaatatcctgattatcctgatggaaggtttcggagccactatggtagaatcattgggaggtgtaaaaggtgccagcccgaacatcgaccgtctttcgaaagaaggtatctggtttaccaactgctatgccaacagtttccgtaccgacagaggtacagtctgcacatttagcggctatcagagctttccagacctttcggtaatgaagataccagccaagagccgaactttgccttccatcgccggaaaactggtaaaagaaggctatcgtaccgacttcctatatggaggtgacattaatttcaccaacatgaagagttatttgctggaaagcggttatcaaaagcttactgccgatacagattttcccatgagccagcaccagaacgcgtggggagtgaacgatgatattaccttcgatcacctctaccaaatgctgaaagaccggaaagattcctcctggcataccgcttttctgactctgagcagccatgaacctttcgaagtcccctatcaccgcctgaaggaaaagcagcccaatgcttttgcatttacagaccattgtctgggtgagttcgtagaacgcattcgcaaaacaccaatatggaacaatctgcttattatatgtctgcccgatcatggattctattatcctgccgaaggcaacggacacgatgcgcgtatccatcacatcccaatgctctggctgggaggagctgtcaagcaacctatggtcatcgaccaactcatgaaccagagtgacctggcagctaccctgcttgcccaactggacatcgatcacagcgaattcaatttcagtcggaatatattgggcactgaatatacttatccgttcgcctactggacatttggaggaggctgtgcctttgccgacagtaccggaattacactcatggaccttaacgtggaccaaccggtactggaaacgccttcacccaacgagaaccgtattttacgaggtaaagccattctgcaaagttcttacgatgacctgggtacaagataataagtcatagagaaatcatctttatacagcaacaaaaaactcatcgccggacccctgataacaatatggtctgacgatgagttttttattctttaaactagcagaatattattcgacaaactttacttttgctgcatcacgcggctttgcagcaggagtctcatccggataaccaaagccaatgcaatataagagttcatatccttcgctgaatcccaacttctgcaagtattcggctgcctcagggcttctcataaagcgtgccggagtacccagacaacaactgccgatacccatagaccaagcagaaatcatcatgttctcagctagcagtccgcagtcaaaaggagaactttctgattgtgtatcacgaccgataaacaccaccgtaggcgcattgcggaacatattcttaaaagtcggatcttcggcaaccttcggattggccttcttatatagttctgtcactccgttgatataatcagcattatcaactacacgtacttcccatgcctgacgattcatagcattaggagcattgataccgcactccacaatggtctgcatcttttcccgttccactgcttgcggcttatactgacggatgctgcggcgtgtcataattgtttccactacctgattctttacactatcttgtgccggagtttctgccggagcctgttgctgctgtgctccacccccacaagccatcaaaggcaacaataatacagtcaaagccgcttgtttcaagtttttcataagcattcttttatcaattaataacgtttgtccataaactctcttataaacagtcttaaagcaactaaaaacatttgcctaaagtcggcataaaaatagatttttttccgctattacaagacttttccctcaagaaaatcagcaacaaccatcagacgcgaaacaaaaaaataagaggatactctttcgagtaccctcttacgctgattatcttgtaacgttaagttctgattacaatttcggaccagcagcaaccaaagctttaccagcttcgttacctgtgaacttagcgaagttcttgatgaagcgagcagccaagtctttagctttttcttcccacttgcaagcgcaatcgtaagtgtcacgcggatccaagatcttcggatcaacacccggcaattcagtcggaacaacgaagtcgaagtaaggaatagtcttagtaggagctttttcgatagaaccatccaggatagcgtcgatgataccacgagtatcacggatagaaatacgtttgccagttccgttccaaccagtgttaaccaagtaagccttagcaccagtcatcttcatcttcttaaccagttcttctgcatatttagttgggtgcaatgacaagaatgcagcaccgaagcaagcagagaatgtcggagtcggttcagtgataccacgttctgtaccagccaacttagcagtaaatcctgacaggaagtagtactgagcctgttcttcgttcaagatagatactggaggcaatacaccgaatgcatcagcagacaagaagataacttgttttgcgtgaggacctttagaaaccggtttaacgatgttgttgatgtggtagataggataagaaacacgagtgttttctgttacgctcttatcagcgaagtcaatcttaccgttagcatctacagtaacgttttccagcaaagcgtcacgtttaatagcgttgtagatatccggttcagattccttatccaagttgataaccttagcgtagcaaccaccttcgtagttgaatacaccttcgttatcccatccgtgttcgtcatcaccgatcaacagacgtttcgggtcagtagacaaagttgtcttacctgtaccagacagaccgaagaagatagctgagctcttgccttccttgtctgtgttagcagaacagtgcatagaagcgataccacgcaacgggttgaagtagttcatcatagagaacatacctttcttcatttcaccaccgtaccaagtgttcaggataacctgttccttagtagtcaagttgaatacaacagctgtttctgagttcagacccagttctttgtagttttcaactttagctttagaagcgttgtaaacaacgaagtcaggttcgaatgattccaattcttctttagaaggacggatgaacatgttagttacgaagtgagcctgccatgcaacttccatgatgaaacgaactttcagacgagtagcttcgttagcaccgcagtaaccatcaactacatacagtttcttgtttgacaattcttttgaagccaaagctttcaaagcgttccaagtttctgtagtaacaggtttgttatcgtttttgtattcttctgaagtccaccatacagtgttttcacttgtagcgtcttttaccaagaatttatctttaggagaacgaccagtgtagataccagtcattacgtttactgcacccagttcagttacctgacctttttcataaccttccagaccagcttttgtttcttcagcgaacaatacgtcgtaagaaggattgtgtacgatttctacggttccagtgataccgtacttagtaagatctaaatttgccattgttcaaatgattaatttggttattatatcaaatgtttagttttccgtttataccgtccaatagaccagtaagttcagaccccctcgtctttggcgatacaaaagtagtagtttatttttaaactaaagaagttattacagaaaaaaatccgtaataaagtaaagatttatacttgtgtaacaaatctgtcatttcgacattgcaactatgaatattatgacctgaaacaagaagtctgtttacctaatttttcaagattaaagccctatcaaaagaaattcacgatacaaataaaacttccgaagtcgcaactatccttgctttactaactacctctaataaagtacattatttgacagtatccaaagttccggacaatctttactgccaaaggaaatgtttatcacttccacatcggccataacacatccgcatcgccatatccggaaagaagcgaatacaaacaaaaacaagcccaagagtacactaatcctcctatttatattgctaaaacttatcttgccgactttacctccacaagacacaacccgtttacacctgatatatttcacgaattatccgtatatttgcggcataaacatgtaacaatcaaaaaagagaaacaatctatgaaaattgtagaactgaaccggaataatagtattctaaaccagtatctggcagagattcgcgatgtaaatatacaaggtgacagcctgcgtttccgccgtaacattgagcgtatcggagaaatcatggcatatgaaatcagccgtgaccttccttatcaaccattggaaatacagacgcccttagccatggcaaccgaaaatgttcctgtcatacagcctgtcattgctactatcctgcgtgccggactgccgctgcaccggggattcatcaattatttcgaccacgctgagaatgcttttgtttcggcttaccgcaaatacatagatgccgacaattttgatattcatatagagtacattgcttctccacgtctggacggaaagacactgattctggtagacccgatgctggctacaggcggttcaatggagcttgcctacaaagcattgctcaccaagggtgaacctgcacacatacatattgcatccgtcattgccagccgacaggcagtggaacatgtacagaaggtatttccgcaggacaagactacggtatggtgtgcagccgtcgatccggaactgaacgcgcactcttacattgtaccgggactgggagatgccggtgacttgtgttacggagaaaaagaatagaccgttttggaacagacccgttctcgtttcgaaaactcacgagcaaatctgaattattttttgtacaaaaactaaaatcttttgtacaaaaaaaataaaaagataaggccgtttctcttctttcttgcagagaaacggcctatattttaaagagatttcatcttgcattcacgacgttcaatagtctatgttagtgcaagcatatctctgtctgttaacggattattttatctcccaagtatcattggtagctagcagttcggcaaaattatgatatttcttctttgctgagacttcttctatctgtgcttcgacagccgcatcgtaggtcggagcttctacatcacgaatcactcccaaggctatcgggaaatcaggaccttccatcagagccagcttcagctgaagagtatggtcttcacagtgagcatcgtgtaccagaatatctttttccgtaataccgttttcgcccaatttgacaaccttcagtccgaaaccttcctgcatcaatccaaattccttattcggaccgaacagcatcggcttaccgtgctccagataaatggcattacgctcacggtcttccttcttcgctacagcgttgtgggttccgtcgttgaaaatcacacagttctgaaggacttctactaccgatgtccctttatggcgggcagcggctttcaaaacgtcaacagaagggcctccgtcgactgccacacaacgggcgaagaaacgtccgcgagcgccaaagcacaattcagccggacggaacgggtcttctaccgtaccgtatggcgatgacttgctgacaaagccacgtgctgaagtcggagaatattgtcccttggtcagtccgtaaatacggttattcaataaaatgatgttaatatccacattacggcgaatggcatgaatgaaatggttaccaccaatggccagtccgtctccatcacctgaaatctgccagatggtaagagcgggattcaccactttggcacctgtagcaatggctgcggcacgtccgtgaatggtatgcatgccataggtattcatatagtaaggcaaacgcgacgaacaaccgattcctgaaataacggctatttcgtgaggtggtactcccagttcggccaatgccttatgaaaggaattcagaaatgcatggtcgccgcatcccggacaccagcgtggctgaccagccttgtaatctgctgctgtatattttgtttcgctcattgtttattcctccattaatttagtgaatgcttcaaccagttcctgtacgacaaaaggctgtccctttacctgattgaactgatgcaggtggataccttcaactttcatgcgcaagtaacctgccaactgtcccatattttgttcggctactacaatcttcttatagcgacggagtacatcttctgtattcttaggcaaaggattgatgaatttgaaatgagccagtgcagccttctttccacgtttattcagttcatccatagccgaatgcagatggccgtatgttccgccaaagcctacaatcagcaagtccgcatccggattgccttcaatcttcagttctggagtagaatcggcaatcttcgccactttctcggcacgcagatgagtcatcagattatgattttccggctcagtagaaatagctcctgtttcgttgctcttttccaatccaccgatacggtgcataaagccttccatacccggggtagcccagtaacgtacgcctgtctgcggattacgctggaaaggtgtccacgttccggccatgtcgggagtaacatacggaggacaaatagcaggatagtcattcatatcgggcaagcgccatgctgccgaaccgttggcaatataagcatccgtcagtaagacaaccggtgtcatgtgttccaacgcaatcttacaggccatataagctgcgtcgaagcagtcagtcggcgaagatgccgcaatgacaggcatcggactttcaccgtttctaccgtataatacttgcagaaggtctgtctgttccgatttagtaggaagaccggtagaaggtcctccacgctgtacgtcgacaatcaccaacggcagttctgtaatcaccgccaagttcatggcttcactcttcaggcagatacccggacccgatgtcgtggtaacggcaagcgcaccggcaaaagcagctcctacggccgaagcacatccggcaatttcatcttcacactgaacggtcttaacacccagtgatttatgctttgccagttcgtgcaggatatcggtagccggagtaatagggtatgagcccagataaagctgcaagcccgctttttcggcagcagctatcagtccgtacgccgtggccttatttccgttgatatccatgtaacgtccctttaccttctgctccttgctgggcaccatataactcatggcaaccgaagcgtgggtgttttctccaaaatgataaccgtcgtaaagaactttcacgttagcttctgctatttcgggtttcttcgcaaacttttcacgcaacagtttttcgcctacgcttatgtcacgatggaaaagccagcacaccagtccaagggcaaacatattcttggtacgcatgatggacttgttatccagcccgctgtctttcagactttccttacacatcgttgtgatggcagcttccactacctcatttttaatgccaagttccgagaacggattttccagcatgaactgggctttttccagatcgcgctttgtaaaagaatcagtatcgataataataaccgactgaggtttgcaaaatttatactgtgtcttcaatgcagcgggattcatcgctaccagtacatcgcatttgtcgcccggagtatatacttttccggaaccaatgtgtacctgaaatcctgatactccggtcaatgttccctgcggagcacgaatatcggccggataatccggaaaggtactgatatcatttccttcggcagccgagatattggaaaacatattccccgccagctgcataccgtcgcctgaatcacccgagaagcgaacaactacatcatccagctccttgactatcatttcttctgccataatatgctatttaaagtttacaaattcactagtcgcaaaattggcgaacttcctttaaaaatcaaaataaaactgcatttatttcatttgtaaaggtatacctcaagtttttcaaacaataatagtagaatattctgaaaaaacagtaaatttgcaatccctgcccttgtagttcaacggatagaatagaagtttcctaaacttttgattcgggttcgattcccgacgagggtactttcacaaaaaaaaggccatgtcaaaagacacagcctctttccgaaaaacaaattagagttttattctgcttcgttcagtgttgcaatacttacacggttccagtcgggttccgagaacatagagcctacaccctgaccttctgccgtaatacggttttcttttatcttgtacttgttcatcaagatcgtttttacagcttcagcacgttgtctggcaatgcgtgcatttacttctgcactaccttcgggcgaagcatatcccttaatcactacagtgctggcaggattgttcttcatgtaggtagcaatacgctctacattaggcaactgatctacactaacggtagtctttccctgaccaaaggttacaaccgattccaatgacttggaatgagtgttctgaaccaccgtttcaacctttgcaggagcattcatacactcgttcagctttcctttcagttcttcgttctcattctgcaatgcttcaatgtctgcattctttgcagcagattcagcacgcaggttgttgattgcttcattcagtctatcaacttcagtctggttgtaaggtgtctgaattgtctgatagtgctttccgttgctgcttgcaaagtgataagtcacaccagccagcagttctacagccgacttatttacattcaatacgtgcgctctgtttccatccatgcggtaaacaatggcaggacgtacattgattgtccatgctttcgattctcccagattgaaattgaagcttgctccgaaacggcttaccatatacgactgatcgtatcccatgctagagttcatgaaatcatgtccccatcccatgccggcaatggcctctacttcgaatactctaggctgtcccagataagttccgaataaattgttcaggttaatcttacctaatacacccagattcaacgcatcgaatgccgtacggctagcgcttgtattcacagctgtcaatccttcgaatgaaactcccaaaactggagttacctgcttacccaactctactccggctacgccacgcatgttcttccagaaagccgaatgtgtagttggagtaatacctcctccttttaccccgatgtaccaattgtcaaaaaacttgttacctacgtatgcatcctgtgcattacttgctacagcaacagcagcaaatgccattgcgaagagaaatttttttctcatacttttttaatcttaaaatagttagttagttgtttttgtttcttactgttcatatataaaacaaatctacttggactttgttcataaaccagattcacatgaaaaaataagaactgttcccaacatatagaaaaatcaaatttaaagtatgaaatcggccaataaagtccttaccctgagaagaaaaaagagtactaaaaaacccctgccatcgtttgatgacaggggctatttttttcaaaaaatattttatagaaggtatggattaagcttctgctccttctgtatctttcattttatgtcccattgtcagataagcaaccggagctgcaacgaacaatgaagacagagtaccgataacaacacccagaatcattgcgaaggcaaagctgcggatactgtcaccacccaggataatgatactcaacaatacgatcaatgtacttaatgaagtattgatagtacgagccaaggttgtattcagtgaatcgttgaacaattttgcacggtcacgcttcggatacaagtggaagaactcacgtacacggtcgaagataaccaccttatcgttgattgagtaaccaatagctgtcaagatggcaccgataaacgtctggtcgatttccaatgagaatggtaaaataccataccagagagaatacataccgataatcaatacggtatcgacaaccagcgcaactgtagcacccacactgtaggcaatgttgcggaaacgaatcaatatatacagaccgattgcgatcaaagccaaaacaactgaccaaatagctgaagtcttgatatcatcggcgatactcggacctactttctgtgaactgatgattgaaccacctacacggttatcgcggtcgataaagatttcaagagtagttcctttacccagcaggttaccttccttcaaggcattgtacaagaactcttcgatttcggcatcgattgtaggagaatcttcttcgatacggtagttggttgttacacgaatagtcttaccatctgtacccaatgcgatagcctgtacgtttgcatcgcctaccttcggctgaagcagatcacgcacggtttccggctgtaccggctgttcgaactgtaccacaaagttacgtccaccagtgaagtcaatactctgtgccagaccacgaacgaagaacgaaatgatacagataacgattacagcgccccagatcatgaaagaacgtttggtaacacccataaagttataatgtacattctgcatcaggttcttcgaaatgctggtagtaaaggtcaagttcaaccacttgtccttattcatatagtgttcgtaaaccagacgagtcaagaatacagcagtaaagaacgagcagaggataccgataatcaatgtagtggcaaaaccacgaataggacctgtaccgaagttaaacaagataatacctgtgatgatagatgtcaagttagagtcgaagatagcagagaatgcattcgagtaaccttcagacaacgcctgcttggttcccttaccagctctcagctcttcctttgtacgttcataaatcaatacgttcgcatccaccgccatacctaatgacaataccataccggcaataccagacatggtcaatgcagcctggaaggaagatagaatacccaacgtaaagaagaagttaacgaacaaggcgcagttggcaatcatacccggaatgaatccatacatcacgcacatgtaaatcatcaggacaaccagtgcaacgataaatgaaacaataccctggttgatagattcctgacccagtgacggacctacgatatcttcctgaacgatacgtgccggtgccggcatcttaccagatttcaacacgttagccaagtctttagtctgttccggagtaaagctaccagaaatttcagactgtccgcccgtgatttcactatttacacgcggagcactatatacatatccatccaatgcaatggcaatagacttaccgatattctgttttgtcagagtagcccaacgacgagcaccttctgtattcatcgacatgcttacacaaggcttgttgtattggtcgtaagaatctcttgcatcagttactacatcaccttccagcggagcacgtccgttacgttctgtagacttgatagcatacaattcgaagatacgtccgctcttgtcgaagtcagcagcagacacaccccacatcagtttcaaatcgcgaggcatctgcttctgtatttccggcatacgtaagatacgatttacttcagcagtatcattacgatcagcgtatgcaactactgcacctaccccattctgattcaactgaagaatagaaagcaacgggtgttctttctttgcctgttccatattggctgtagttgcagctgtttcacctttcaaagccgcagccaaactatcttttgctgaaacagcaggctgatcaaccgcaacagtatcagtcttgacagaatctgttggagtagtacttagcaactcacgggcacggctatcagcagaagccaatgcaggaacgatttctttcgcttcgaaagtttcccagaattcgaggttcgcagaaccttgcaacaattttctcacacgttctggttccttaatacccggcaattccaccatgatacgttccatcttaccttccagtgtctggatattaggctgagccacaccaaagcggtcgatacgtgtacgcaatacgttatatgaattgtctaccgcagcctttacttcttcgcgcaatacagcttctacctctgcatctgtgctacgtgtagttaccttgtcttttaattgctgagttgcgaataactctgccagactaccttccggagccagcttcttatattcacgaacgaaaattgtaatgaagtcatcctgactggttacttgttgtttggcagcctcagacaaagccttgttgaatgcctcatctgtcttgttgtcagccaaagccttcacaacatctggcactgaaacttccaaaataacgttcataccgcctttcagatcaagtcccaatccgatttccatctcacgacactgtttcagcgtataactgcccaaccataccttttcattctgtactgaatcaaggtagtgagtttcccctttcggatcctctgccgcctttttcatatgatagcgggttacaaaagagaacgaaagatagaacacacatacaagggtcagcaatatcgcaaaaacctttacgaatcctttgttttgcatgttactttaatttatatatttactttttaattaatatacgtttattcaaggttgcaaatatagtttttttttcattcacaaagggaaaggtttctaaatatttaagttttaaagcgtaaaaaacaactatttgttgcatttatatcgactgagaaatctgatttaccgctgtttaccaaactactaaaaggactatttttacaagaattctttactttacaacaaatacacaaaaaaatccggaaggttaacttccagatttcttttattgttttttctccaacaaacaccatactggatagtggtcggaggccttaatagaacggtccacctgacatttcaaaatgcggaagccatcgctggcaaaaatatggtcaatacgaaaatagaaatgattctcattgtatgtaaatccgggaccggaggctgcttttgcatatacatcattcaatccctgaccaatgactcggtgagcatacgatataggagagtcattaaaatcaccgcataccagcatgtaacgagtacggttatctaaaatagcataagcaaccgaatcggcttgaggagcacgtatagcaactgcttctgccaatttatgtagtaaataccggccaccatttttcacattttcttcacgcggagaattcaagatatcattataaacgactttatcatgtgcatcgagcttattcgactcaagatgattattaataaggactaaagtatctttacctaattttaaacgatataatacacttccgttatattggctcgaataatccaagcacgtctccgataaaataggataacgggaataacatgctaatccacttcctcccttaacgcgtatcatcttatgatatggataaacatccaatgcctgatccacttctttctgtttcactttcccgcccggcgtaaactcttgcagacaaataatatccgcatcactattccgcaaataattgagtacaggattgccttgctccctgtcataatctctcatcgcagcaatatcctgcgtattgtaagtcagcagtttgatgacttctccaccgtccggttccttttcagtacccagcggacaatacgtccagatactactccatccggcaataaacaccagaagagggaaaaaagcatacttccacctgatgcaaagccaaattaaaagaaaaaataaattgcctaaaaacaggaacggaaaaaacaaaccagcacatgcccacaacggatgactgaccggtgaaatatacggactataggcacttatcagaaagcctatggcaaccaatacgttcaaggtgaccaatacccaccgaatcaaacatccaatccttttcataataattttatttttacattatcaaaaaaacagttcaggggaaaaagagcattacttcttgcttgcatcaaacaggctctttttttcggcatctgtcaaactgccgtaacccgatttgcgaagtttatccaaaatacggtctatttcttccgtacgttctttctttctggcattgaagtcatagtctttctgcttatcgctgtaatgtaccttcattttcggtttgcgaggagaaggcctccagccgcccgcaaagaaatcgagtacattattaatccatttggtagcatcatgccctttttgcaatcctgccgcaaaccaccagccagccaaagcaccgcccaagtgtgcaatatgtccgccggcgtttcctgaagtcatgaacagtaaatccaacagcaacataaagatagcaacatgcttcagtttcactgtaccaatgaacatcagctgaataggataattaggctcacgtactcccacagctatcacaatggcaagtacagaggccgaagctcccaacaaataagaagaataaaccgcatcggcaaaatacgggaacagattatatgccaccatgtatgccagtccgccgacaattcctcctaacacatatagtccgcgcaggtgttttgccgaaaagaattgcaagaataaacgtccaaaccaatacagccacagcatattaaacaaaatatgcaatacaccggcgtgcataaacatataggtaaacaaggaccagggctgccggagaaaccgctcccaccaagcaggaaattccaggtaattggcccataatccgacaggctgattaaacaaagtcaatgctatgtttaccagcgtcacaaccaaaaagactcctatattgatatacagcaactgggtgacaatatctccccttctgaagccttctttcaaattagtaataaatctgctgtccgccgccatttttcttcctccagtaaataatcagtatcaaaccaaaaagcataccgcccaagtgagcaaaatgagcaacaccgtcacttccggccagtcccagtaccaattctagcaccgcgtaccctataacaaaatactttgccttgataggcatcggcagggggaagataaacatctgactattgggaaagagcataccgaaagccagcaaaatggcatatacagctcccgaagctccaactgtattcagacggttcagaaattcactcatcggtatgacacccataccagtatcaacaccgtcgtaatgtgaccaactgaccagatactccgtatattgtacagcctcctgtatcagtccggcacctattccgcacaagatataatacaataagaaacgtttcggaccccaaacttgttcaagcacccggccaaacatccacacagcaaacatgttaaaaaagatatgctggaaattggcatgcataaacatatacgtaataagctgcgccggattaaaatcggacgcaaggaaaaaatgcaatcccaacaaattctccacatcgatgccatagcgtcgtgctacaattgtgccgaagaagcacaacacattaataatcaacagattttttgttactgtaggaatggtattcatatatatattattttattcatgttttacaatactatcgcgaagaaccagcaaactctcaggtcccatattaaataacaaatccacaatactgaggttgggcaaaaagttatttttctggtcgaacacctgataataaggtttaggcaagaattccggatcgcactccgtatacaatttcttgggatgaagccgttcgcggaaatcatcctgcccttctgaagccaccatataatcccctgtagatactaaatgcggatgaagatctatctgctcacaaacccagttgcataattccagattgaaatcgaacaaaaattcgtatttctgctcaaaaaagcaatgaaactcatcggcataataatcgaagaaaggactctgtttgtaagcagccacaaaagcattccaatgcacatgccgccaattgccatggtcggagatacgcacgtccttcatcaagcatttcaagtcctcactcttttctgtcggaatggtgagcgacagggctccgcccgacgaagctatcacgcagcggttgcggtaagtctgcttcatataatggtcgaaccgttctacatatacggtatcgtatgcaaacaactttgtataatattctactggcgcaagatacgccgaaccaagtatcacttctttcttcatgctactgtatgcgttgaaaaaaacgtcctttataaggagtataccagatacgccatgccttaccgatgacatgatcttcgggcacgaaaccaaacaaccgtgaatcgcacagattaacagggtcattcgatgccatccaataataatccttgctgaacgtaaacgaactgacaggctttccttctacccataaggtatcgccccgcacgccagcctgcttcccttcgtgcgaaacaatggtattgcacagcaaaacaacattccacggataaaccttcaccgattcccctttacgaggaacgacataaggatgcacctcctgagaaagcttgctgttcagtgaaacaaaatcgatccgctgaccggctttctgagacaccagataaaactcataatgactgaaactgcggatatagcccccgtcttccgtatatcctatcagtggattttccttcaggcctaccgcatccaaaatcacacgcatcaagtcttctttcgatgctggatatacatacaaagctttactatcgggactcagcacttcatcgccgctgtctatcatttcccggttcagcatgagtgtatcgcccggcgtgccgatacagcggctgataaagaccctccgccattcaagccgtttattccgctgcgtagcccccggatcgttgaagagtacaatgtcacccttctctacctcacaactcccgatacggtgataacccagaaatgacggaaaaggcatacgcaaaccataactccacttgttcaccagcactccttcgccctgataaagcgtattttccattcccgacgaaggaataaagcaagaagtaacaagaaaagtcttaaccagccacacggcaacaacgacaagcgccgccagcttcagtcctattttccagttgttatccaccaataatctgaagtcgtataactcattactttatagaatcgacaaacttaaacaagcggttccagcgaatcttaccatcgaaccaccctctgtcctgatcgagcgacagccagataaagatgggtttacctacgatatggtcttcgggaacaaatccccaaaaacgtgaatcggcagaattatggcggttatcgcccatcatccaataataatccatcttgaaggtatacttcgtcgtttcctgcccgttgatatagattttaccatccttcacttccagcgagtttccttcatagttcttgataggacgctcgtacataggcaggttatctagtgtcaagtcaattgttgcgcctttctttggaatccagattggtccataattgtcgactgtccaacccgtcagcttgtttaccggatacaatcctcccgcatcgtcatcgggtgtattttcgatagataccaccaaatccttccgagccagcaaagcagctttagctttctccgtcagcggcatgttatacaccgattcttcagtataatacatcgacaagtcctcctgactgatacccagttcgtgacacaaatcatcggggagcattcccttggccttcacgaaataacggtactgtacattatcaggttccttgttggcttttccatccagatagataatacggttctttatctgcaacgtttgtccaggcaatccgacacagcgctttacataattctcacgacggtcgaccggacgtgtaataatcttaccgtaggtctgcgggttctcatcgatatacttgcgtcccgcctgataatagaaatcgtacacctgacgctgctgctccagtgtcagacgcgacatatctaccggctgcgaaagctgctgtccagcctgataactcaagcgatacaagtcttcagcaggaacggctgtcgctacgctgtcgccggcagggaaattgaacaccacaatgtcattcaattcgacctttcccagaccaccaacacgcttatagtcccaatgtatccagtcgaggtacgacttgcagttgaatattggaagcgtatgctgcgtgagcggcatgtgaagcggagtctgcggaatacgtgctccgtaactcatcttgctgacaaacaagtagtcgcctaccagtaacgatttttcgagtgaagacgacggtataacgtagttctggaagaaataaagattgacaaaatacacggctaccagtgcaaagacaattgcatccacccagctcatgacagtcaagacggtcttatttttcgatttcttccaccaagtccatggaattttctttgaaatataagcatcgaagataaaaggaaccacaatcagtcccagccagctctgcaaccagatcagaaaaatcaggtacagcaccagtacgatgccaaactttatccactgcttacgtgaggcctgtatcataacttaaaactgaaataaatcgttcatacctaaaaatccttcgtggtttgccgtatattcggcagccagcactgcacccaaagcaaatcccttacggttctttgcatcgtgagtgatgataatcgaatcggcttccgactcataacgaatggtatggatacccggaacctctccttcacgaatagcgctgataggcagttcgtcggcagcacattcggttgttccgcttactgtaccatccggagccgtgagtgtacccattacccacttgttctttctgtctaagttctccagaataccttcggccagtgttatagctgttccactcggagcatccagtttgtgaatatggtgtgtttcgaccatcgacacatcgtaattggggaagttattcataatctttgccaggtatttgttgaccgccgagaaaatggccacacccagactgaaattagacgaccagaaaagggtctttccttcttctgtacacaaacggcgcatttcctcaccatgctcattcatccagccggtactgcccgataccactttcataccattcttgaaagcttccagacagtttccataagctaccgaaggagctgtaaattcaattgctacatcagccgaacgaaaagcttctgaagcaaaatcctgacggttgtttatatcaataatacttacaatctcgtgttcgcgggcaattgcaatcttttcgatttccttacccatcttaccatatcctattaatgctatcttcataaatctcaaattattttaggcacaaagataacgtttttcgttattaatcattacatttagcgaacatttacacctcattaacatggaagaactcttgcactatgtgtggaaacacaagcttttcgcactgaaacctttgcagactaccgacggacaaccgattgaaatcattgacccgggactggcaaacatgcatgccggaccggattttttcaatgcaaaaatcaagataaacgatgtaacctgggtgggaaacattgaaatacaccagcaggcttccgactggtttcgccacaatcatcaccttgatccggcatacgactcggttatcctgcacgtggcttcggacattgacgctactcccacgcgaagtaatggagaggtgattccacaaatggaactgcactacccgccttatttgctgaaaaattatgaagagctgatccgtgccgatcgctatccggcctgtttccgcattatcccccaacttccgtccttcctgttgcatagctggctgtccactcttcaggtggaacgtttcgagcacaaaacgcaacacatagaaaagctcttgcaggaatacaatcacgactgggaaaatgtgtttttcattacgctggcacgcaatttcggatttggagtaaacagcgattccttcgaagtatgggcaaagaatattccgctggcagcggtcaacaaacaccgcgataatctgtttcagatagaggcttttttcttcgggcaagcaggacttttgcaagagttaccggttgatgcgtatacggaaaacatgatcaaggaatacaattatctgaggcagaaattcggtctgcaaccttcttccgactgccgctggcgcctgcttcgcctgcgtccgggcaactttccgcatattcgtattgcgcagcttgcctgcctgtaccaccgttcgcaaggcttgttttcgcaattgatggaaacggaatcgctgaaagagctgcgcaatctcctgaaagggggaacttcggaatactggctgacacactatacgtttggtactccctctccttcacatcccaaaaccatcagccagaactcaaccgatttgcttatcatcaatacggtaataccatttctctatgcctatggcaaacacaagtcgaacgatgctttgtgcctgcgtgccactcaactgctggaggaattgaagccggaaaacaattatatcatccgcatgtggaaagaatgtggactggaggccttacatgcaggcgacagtcaggcacttatccagctcaaaaagaattactgtgacctgaagaaatgcttgtactgccgcatcggatatgagtatttcaagaaaaaagaaatataatatttcgaagtagtaactaatttttaactgtatctacttttatctgaatagaaggaatataaatagtttgaacagaaggaacagtaatagttcctctatcgatattagtaacttctgcttttacatcattcacataaattttatccaacggataatatagcttataggttggtaaagaagttatccattcggtctttatattcaccggttctgaaaatatatcttcacatactaaatcaaaagaaaatgaagcagtacgatcatctccatcaccaataacatcagtactattcacactaaaataataatgcccatcttccatgtagccccactttaagtcaaaataatcacactctacatattttgaagtttcaggattcagccatttgagttccattttatcagcaagtgtctccatgtcatccatgttatcaataaatggatttccattttcatctaccagctcgaaataaaattcgtaaacgctaaactcaacatttttaacatttttatcacaaccacttatcaaaataaataataacaggactactgaacttaaaataaactttttcataagctaattagattcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgtagattaataagaaggtattataattaattgttgcaaatcatctgggaatatttctggagaataaaaccaaccattttttgttgtaccttcattagcccatccccaattataatgttgagaggcaattatagcaggactaggattccctcccgctagatattttgttttatctctttcataataataagacccgttgcttcctctcaaatattccaccgtaaaatgtttttaagagcatctttgaaagaatcgcaatatgctatatattattacatttacaaatgtaaaaaaaaaaaaaggttatccaaatattttataaggatttatcaacacgttatgatttctttttcgattacgatgaaaacaggtccttgcctttcaaacgtagtttacggaactttgacaaagaactggaggaagcataaaatttatttttatatctatgaagatacaaaaaatattggtacatagcccaatatttcactaggtatgtaccaatatttttatgaatttattgttgaaggcactttttctgtaccctcaattaatttgtatttcttttagacaaaggtatgtataccatcaattcccagccagacaaacggttgtttacaaaagggaataaatcgaatttccgggttattccccgcttatattgtatggcaatttccatacaaccaaagtcataacccaaacgtgcaaacactggtacattcacaaaatctttatcataaaaataataagcagattctactcctacagataaattcaatcctttatacaaataatatcccacacttccggagagagagaccgacaacaaattgcaaactcctgtatttcccgcataagttatgtgctcgtccggagagagatagcttaatccatacttataacgatgatatccggctattatcgcaagatcgaaaaaccatcgggaatcaatcggcttcaaccgccaacgataaccgaaacctaaagagaatctggaatcaaaataagtcttcccggtatcaaaaggaggtaacccggctgagggaggaaccatatcataacttaccatatcctttcctccataaattgtcaggcctgaggaccgacctgtctgtccgtaagtaaccagccatccactaagcaataataaaagaatagtcaaacgctttatcatacaatcaattcttgtgtttaatcaattacttctaacttattcttccacactatccatccattccgtttgtatcatccggcaaccacctaccagtcctagtccatttgttacattggtataggtagggcgtacaggagccaattccgattctcccaatttattgtttacttgttcattcatcgacttcagataatgatagaactcttccgacaaactatacagacaaaccttatattgtttcctgtttgtataaacttcatcctgaatagaggtttcataatcggatatataagtcttgttcagccgaagtgtgtagttctttccttgaatcttctcatcgctccaaatatacaactgctcataatacgtatagtcgcctataagaatttcatccaaaccggctgaaaccttcaggagcggttcatcgtcccaatccatatatgcagtatattctttgtcataatacacccgtgattctccattcctccaatacttcgctctttctttcaccgttacggcataatagtttactgtactagcctcatcggtaaagtttatctgaaactgaagcgtaccaggatcggatggctttcgttccatatgaacagaattcaacggaaacggagcgggaattgtcgtaacagacgaaacggtttccagaccttctgcagaagccgtcagccggatacgatcgccttcctcgtatgtctgcaccgtataataacttttggcgggaacacccggtaaagctttgtccgtccacaacagaccgacaggtataccgtttacttccagccggacatccgtccctgccaaaccggaaacgatttcccccttgcctgtgactggaagacttcgtgaaagacgtaccacggttgtatctccactcccgggataactgtatacaactaacttagggattccttccgcctcatccagatcgaaatgatatacgcaagatgtaaacagtaaggataccccaagtatgatcatgaaagaaatatattttaccatcatccttattagaattttaaagtataactgaaagaaggaattacaggaaacaatcctatcgccttgcctctgaaactaccatcggcctgccgttctacttgagtatagaaagcattcatccggcaataggcattgtaaatactgatattccagatacgttcgaaacctcgtttggtagtccgccggaaattgatgcctacatccagccgatgataggctggcagggtaatattgttcggcttttcgtagccccagcttcctgccgcatcagacggctggacggttccaggcagagaaggattttctacatactgcataggcacagtagcccgatcgccactacggaaagtccatgctgcgtacgcatcgatacggttattaaacttatgacggaacatcaggttcagcttatgacggttgtcaaacttgctggcataccagtcggggtaaaaatcttcgaatttctgcttactccacgacagcgtataactggcctgaaagacattctttgcgtgacggtacgccagtgaggcttccaagccatacgattttcctttgcctaccctcacccatttctcccaattatcggcaggaagtgtcaggctaccaccggtatcatattccagcatccggtcggtggtacggaaatagccttctatgtccatgctcaaattccatggaagcttcatataaatgcctcccgccacctgacgtgaacgcatcggacgtatgcgactggtagaaggaacccagcagtcggtaggaagattcaagtaagagttcgaaagctgatgggcaaactgactcatttcagtataagaagccttcaaggtagcccaatcgaaaagccggtaaccgaccgacaatctcggttccaaggaatgataagtcgctcccgtaacccgatacaagacatagtgtagacccgcatttacccgcagcttttcggtcagctgcatatcatcttccacataaaaagagatttcactcccccgataacgaccttcacccgccgacgacaaggtatcggcaatccctgccgtttctcttatatcctgcgaagcgatacgctgcggatgatacaaatgaaacaaatagttgctacccagacgaatatgatgactcgcagccggacgataactgaactccatccggtaacccacatcatcaatcgtcgaataattgcttctttgcatccgttccatcgacaccctcttgtcttgttcataatagctttcatccgacaggaaactatactttgccagattacgggcatacaccagtgatacattgcccgacagtttaggcgtaagctgaccgttccagttcagccctaccgacaagttgccccaacggatatggaatgtattctcatcccgttcctcgtacttctggaacatatatccttccggaaactgttgcagcactctcgacttgaacagatcgcgggctgaatatacgctgagcgacaacttgttccgatcggaaaaccgatgcgtaattttagcattgatatcgtggaaagcataacgggtcttaatatttttatctgaaaaacttcgattcgctatccacaaggcaggtgtggtcagcagatccatccagctccttcgcataccaaaactaaacgaagtcttatctttgatgacaggtccttcaaactggaacctgccatccagcagtccgatggaaaaagtgccatgatattctttcatgtccccctccttggtacgaacatcgatgaccgacgccgttcttcctccataacgcgccggaaaaccactcttataaaagtctacattcttcaccacgtccgtattgaatgccgaaaacaatccgcccagatgattgacctgatacaacggagtaccgtccagcaaaaacatattctcatcattccgcccgccatgtacatacagcccggaaagcaattccgtgccggaagaaacacccggcaagttctgaatggacttgacaagatccggagaactcaacagtgagaattccgtattcagcaattcgggagtaaaagaaacctttccggtctgagtggtaaaaagcggatcattcagattagctgtaacttccacacctgccagtgcagttgtgctttccttcagataaatagttccaaaatagtcagactgcaaatcgagttcctttaccacctcttcatagccgatataagaaacacgaagcacatgcttcccctcgggtaaagtaatactgaaaaagccatgctcatcggtcagtgttccggtacacgtagtcttgtcatacaccgtcacattaatcagtgattcaccattatcctgacagacataacccgaaaaggtatacttgttctgcctgaacagcagcacatattcatccttgatttcccacttgataccagtcccgccaaaaacaatattcagattctccgccagtgtcttgtcgggcaacggtctgcccgcaggcttcacatcagctaaagcagaatcgtatacaaaacttacatgatatacctcctgcatggtatctatcgctcttttcatctctgtggattcggacgaagcattcgccgccacatgcagacacagcagaacagcacagaaaaatgttctcatcacttcttcttttcaatttttactttcagcaccttttctattatctcgattatttcatccaagcttcgggaattgaaattggcagtcaaccgtttatccgtattgtcagctgtcagacggacattgtaatatctggaaagctcatcgagcaccttttgcaaaggcgtattgctgaacacaaagctacctttacgtgtctgtactccctgcgtaagtacttgaggtttccgttgtcctttgacaacctgcgccctcattccacgtgtcagaattaccgcatccggttgtcctacagccgtatactgaacttttccctcctcaacatgtacaaatgccgtatcattccggctttcatccagcaggaagcaagttcctaaaacctttacttccgacaatctgccacttgccgtaaacggtcgggcagcatgatgacgaacccgaaacgaagcctttccccgtagacggacatcccgacggacagacaaatattcacgggaacaatagcggatggaagaatgaggatagagcattacggcagaactatccggcaacaggcaatcgaccggatgctcgtatgccgtaatctccgtccatttcgcatcagtaaacaagtatatctttatgacaaacaccaaaagtacggcagcagcaatccccgcaaaagccatcacatacgaacgagagcctgacttgctttcgagtatagcatgtttgtgcttaaaagtctgcaatgccttctgtgtatcaagtttatttacacggtaatgcttcagcacgaaccggagacatttttcttctaaatctttcatacttcttcgattttaagtttcatagataagactgtacaaatgctgaaattcactattgccaacaggctaattttagccgaaaaagaaagtatatactttatatgctccctcacgtatcagtcgaagtgctttctgtatatggttatcaaccgtatgaacggagatatgaaacttgtcggctatgtctttatacttcatgccatcccgtttgttcagcagaaacacttccctgcaacggtcgggcaatgaatcgatggcagtccagatacgtgcctccataaccgtacgctcttccacctcttcttcgggtaatctgtcttccagatcggacggggaaagagtcgtatcgaacatgctgttttgtttcagccagtcaaggctgcggtttctgaccatcgtatagaggtacgacctgacattagctatctccccgccttcctgttccgttttttcccacagaacagaaaagcactcttgtaccacatcttccgctgcatctatatcgtgaacatagtgtatggcatacaagcataaaggtcggtaatggtatctgaacaacgtatcaaagtccatattacttacttttatttctgatattatgaaattcggttttctgtaatgactcacaaacgcaggcaagtcactacgatacatttgccaaaagaagttaatttatcaggaatacctcgaataacaagaaagaaagatgaggaagcagaaaagtttcaggcagtgcaggaaaagtcctctgcgcacgttcaaaaacgagccggcacattcctcccgttctttgtacaaaaacttttttgttttgtacaaaaaataaaaaaagacgaggacgttttcatcacttcctgccgacgcttccttcaaatcagcgcagtgcctctgctaccgccctgagataagcatccagacgattgcttttcagaatcgctttacgaggtttcttctccatgtcggggagcagatattcccacatggttttcagtttggcgagcaattgtgcctctcctccctcaatcgtccggctgtaatgttcgtacatcaaccggtgcatttcggctacctgtcgatacaacgtagccttatccggagcttttccttcgcgaatggaacgggcaagcgacgggtcggcaagcaggcctctgcccagcataacgcctttcaatcgcggataggcttccatcagctcctgaacagcctccagtgtacacaaatcgccattgtagactaacggcagttcgcaggcttcgtaaaatgccttgaacgccgtatgattcacttctcccttgtactgctgtttcccgatacgcggatgaagagttacctgaaccacacacgagcggttcaacagcggaaatacctgcctccattcatcggcatcctgccagccaagccgcatcttgacggagaaacggatttccggcaactgccgcatttcctccagtaatgcggagactttttcggggtaaggcaatatgcccgatccctttccacgattggctatcagcggaaagggacatcccatattgacatctatttcccgataaccttgcgaggtgaggaaaccggcaagccggttcagttcttccggctccgaagcaaccagttgaggtatcaggtgacttacggtgttttgtccgggcatcacttcccgcttgtctttgttacggacttctcccttttccagacgaataaaaggagtatagtaagcatctacgccctcgaacgtctgttcgtgcgcattacgccaggcagcctccgtaaatccttgcaacggtgccgcatatattgccggtatattctgttccatacagccgcaaatatacggattattcgttatctttgtagaatacattaaaaaatcatccccatggataaatatatttatgaactgaaaatgaaggtgcgcgactatgaatgcgacctgcaaggtatcgtaaacaatgcgaattaccagcattacatcgaacatacccgacacgagtttcttacttcgacaggcatcagtttcgcgcggttgcacgaggaagggatagatccagtcgtagcacgcctgacaatggcgtttaaaacgcctctgaaaagtggtgacgagtttgtttcgaagttgtatctgaagaaagaaggaataaaatatgtcttctatcaggatatattccgattgcccgacatgaagattgtcattaaatcgacagtggaaacggtgtgtgtcatcaacgggcgactgggcagcagcgaactttttgatacgacctttgctccttatcttgccgaatgaaagaccgtgaattactctgccgtctggcactgactcagcttccgggaataggaatcgtaggagctcataacttgttacaggctgtaaacggacaggctgccttgctcttcgaccatgcccaagagctggaagatattgttccggggatttctcccaagattgtccatgccttcgatgcgccggaagtactgcgccgttgtgaagcagaactcttgttcgcagagaagaaccatatagcctgccttaccagcgacgacgaggcttatccttcccgccttcgtgaatgtgacgatgccccattagttctgttctatcggggaaccagtgatttgaaccagcggcatatcatcagcatggtggggacccgcaatgcaaccgattacggcaaagatatatgcatgcgatttatcagtgagctgaaagaattattgcccgacgtattaatcgtaagcggactggcctatggtatcgatatccatgctcatcgggctgccctgcagtatcagatggaaacaataggcgttctggctcatgggctagacagaatttatccgtcggtacaccgacgtacggctgccgagatgacacaatgtggagggttgctgaccgaatttatgagcggaaccaatcccgaccggcagaattttgtcaaacgaaaccgtatcgtagcgggtatcagtgatgcaacgattgtggttgaatcggcaaacaaaggaggctcgctgattacggcggaaatcgcagaaagttatcatcgtgactgttttgctttcccgggccgcattcatgatacatattcggcgggatgcaacgaactgatacgctccaatcgtgccatactgcttcaaagtgcagaggaattggtaaaagccatgaattgggacagtgaagcacaagctcctgttgccatacaacgtcagttattccctgagctggacgaaaacgaagagaaaatagtgactttgctccaaaagtaccctgacggaattcaaattaattcgctcgtcgtagaaagcaatattgccatcaaccgtatgacaagcatcctgttcgaactggaaatgaaaggcattatccgtacacttgccggaggagtatataagctgatataatatccaacttacaatcttcgggataaggttgaccaaagggcaaaaaaatgggagaacgctttctcccaaccttgttaaccttaaatctaatactatgaaaaaaatcacaatgcaaatgtaccaatttgcaacatatcacgcaagagtaagaaacattattacaaaatgtttaaaactattttacatttaaaagcgtttgcgtacacattctaacagtttgtttattataaaaaagaaaaaatccctgccgaattttacttcgacagggattttttatcaaataaaagctttacagcaaagcattaatctttcagtttagccttgataaagtcacggttcaaacgagcaatattgctgatagaaacgcacttcggacattcagcttcacaagcacgtgtgttagtacagttaccgaagcccagttcatccatcttagacaacatagcttttgcacggcgcaaagcttctggtttaccttgaggcaacaagttcaactggctaactttagctgaaacgaacagcatagctgaaccattcttacaagctgctacacaagcaccacaaccgatacaagttgcagcatccatagcttcgtcagcaaccggtttcggaatcaggatagcgtttgcatcctgaggagcaccagtacgtacgctgatgaaaccacctgcctgcataatcttatcgtaagcagaacggtctaccatcaagtccttgataaccgggaaaccggcagaacgccacggttcaacagtaattacatcgccatctttgaaacgacgcatgtagatctggcaagttgtagcaccttttgcaggtccatgaggatgtccgttgatatacaaagaacacataccgcagataccttcacgacagtcatggtcgaatacgatcggttctttgccttcttcaatcaactgttcgttcaagatatccaacatttccaggaatgaagtatcgcccgggatatctttcatctggaatgtatcgaaatgacctttttctttaggtccgttctgacgccaaactttcagcgtaaatgatatatttttatccattttacttagattctttaattgtttaacttcaccgattagctcttatagttacgagtctgaactttaattgcttcgtataccagcggttctttgtacaataccggagccttgtcatcgcttccctgatattcccagcaagcaacatagaagtagttttcatcatcacgtttagcttcaccttcttcagtctgatattcttcacggaagtgaccaccgcaagattcgttacggttcaaagcatcgtatgcaatcagttcacccattgtgatgaagtcgttcagacggatagctttatccaattcaatgttcatgccttccttagaacccgggataaacaattcggtttcgaattccttacggatttctttcagtttagccagacctgtcttcaagccttctgctgtacgtcccattccgacatattcccacattacgcggcccaattccttgtggatagagtctacagacttcttacccttgatgttcatcaggtgatcgatcttagcctgaacagctttttctgcttcagcaaattccggcagatcggtagagaagcgaggaacagtaatctggtcagccaagtagttctggatagtgtaaggcaatacgaagtaaccgtcagccaatccctgcatcaacgcagaagcacccagacggttagcaccgtggtcagagaagttacattcaccgatagcaaacagacccttgatagtagtctgaagttcgtagtcaacccagataccacccattgtatagtggatagccggatagatcatcatcggattataatatttaacaccattgatttcttttcctacttcacccggatttacgtcggtgatttcttcgtacatatcgaacaagttaccatagcgctgacgaacaacatccaggcccagacgttcgatacattcagagaagtcgaggtatacagccaaaccagtattgtttacaccgtaaccgtggtcgcaacgttccttagcagcacgtgaagcaacgtcacgcggaaccaagttaccaaatgccggataacgacgttccaagtagtagtcacgatcttcttccggaatatctgtcggtttcatcttaccagcctgcaaagcttttgcatcttccagtttcttcggaacccagatacgaccatcgttacgcaaagattcagacatcaaagtcagtttagactgcttgtcaccgtgtaccggaatacaagtcgggtgaatctgtacataagccggattagcgaagaaggcacctttacggtagcaagacattgcagctgtacagttacaagccattgcgttagtagacaagaagtaagtgttaccgtaaccaccagtagcaataactactgcatgagcagcaaagcgttccagcttaccagttaccaggttcttggcaatgataccacgtgcacgtccatctacaattacgatatcttccatttcgtaacgagtgtacagttttactgtacctgcacctacctgacggctcaatgcagagtatgcacccagcagcaactgctgaccagtctgacctttagcatagaatgtacgagaaacctgagcaccaccgaaagaacggttagccaatgtacctccgtattcacgagcaaaaggaacaccctgagcaacacactggtcgataatgttatttgaaacttcagccagacgataaacgtttgcttcacgagcacggtagtcaccaccctttacagtatcatagaacagacgataaacagagtcaccgtcattctggtaatttttagcagcattgataccaccctgtgcagcaatagagtgtgcacgacgtggagagtcctgaatacagaaattgaatacgcggaatcccatttcaccaagagaagcagcagcagatgctcccgccaaacctgtacctaccacaatgatgtccagacgacgtttgttagccgggtttaccaatttctggtgagccttataattagtccatttctcagctattgggccttcaggaattttagaatcaagtatcttagtcataatgttttttcagtttaaatcagttacacttaaattagcaagcaccacaccccatcatgttcttcaggaagaatacaatagctaccagcataaagcccagaacgatgatagtagaatagatgttagagatgcatttccagcggttaatccaaatcgtattgttccagcccagagtctgcattgcactccagaaaccgtgagtcaagtggaaccacaaagcaatcagccaaatgatatacaacacgaagaacaacggattagagaaagtctgcatgatatagccataaccgtcggctgcatgaagaccacccatcattgggttaccgatgatttcagcgaactgcattttgtaccagaagttcataaagtgaagagccagacccaggataacgatgatacccagtaccaacatgttctgagaagcccattccacatttttcgggcgagcatttacagcatagcgttcactaccgcgagctgcacggttctgcattgtcaaccagaaagcgtagataatgtgaattacaaacaaggcagccaatcccacagttgcaaccagtgcataccagttagcacccaggaattcacaaaccatgttgtaagcttcgcccgagaacaaagcaacacagttcatcgccatgtgaaatgtcagaaacaggacaagggcgataccagttacactcatcaccactttccttccaatagatgaattacttaaccacataaatgattgaatttaaattatttaattgttagaactaaaatttcttaccacatacactaaaatacgatacaaaattagaagttttccctagataatacaaggattacggaaataattctttaatatattcatcgtaaacagtgctaagaaggaatttttcttattcttttgcggacatacgacccacatgaaaggacagaatatgaaaataaagaatgccctttcaaagcagaaacttgcgttccataaaggtaacttcttactttcacacacaaacgtctgacaaataaaaacgatcaaagccgcttcagcatcatcttagattgctgaaacggctttgccatgttatctgttgaccataaaggtatcagcttatttccgttcagggaaattcatacccggcttttctaataattccacagccttaagtacactattgttcatgcagttcattacttggaaatattcactcatatcccacaaatcacgggctatcaatgccttcatctgagcctttatcaacggaagagctgtctgatactgcttctcatcatattttgctccaagctgctcaccaagagttcttaattcttccagcatggcaggagttacatcaaaatctttattgaaatgacggaaatctttgtattctttcaaccattcctcgcgatgcgtatctaccagtttcaaattcatctgtataatagctcctttatcgcgtaaagccagataataatctgtatacatcgtagtatctactgggacgaaatagtcgggcataatgcctccgcctccataaacggtacgtcctagctttaaggttttatacttcagggaatcagggaagtggatactgtcagcactcaacatttcacctcgattgtaacgatctatcagatccttattatactgttctatgctttcgtatggcttctgaatgcaacgtccggaaggggtataataacgtgctaccgtcagacgaatcatcgaaccgtcgggtaaatcaataggacgctgaaccagtcctttaccaaagctacggcgaccgactacaatagcacgatcccagtcttgcaaagcacctgtaacaatctcacttgcagaagcagaaaattcgtcaaccaatacaatcaggcggccatccagaaaatcgccatttccttcagcatcaaactctgcacgcggatttcgacgtccctctgtgtatacaatcagctctttcttgcccaagaactgattagctaattcaatagctgcattcagataacctccaccgtttccctgtaaatcgagaatcagatcacgcattccttctttctgcaaccgatgaagtgcatcggcaaactcttttcccgtggtagcggcaaaacgatttacacgaatataaccgatcttgcggtcgaccatatacgcagcatccagactatatacaggaatcttatctcgtttaatcgtaaacggaagcaattccttaactccccggcgcattacctttaccgttacttcggtaccacgctttccacgcaaacggcgcatcacgtcttctgtactcatcttcactccggctattaccgtatcgttcacttctataatacggtcgcccgccagtatacctaccttttcggaaggccctcctgacactggctggataacaaacagcgtatcggtagccatattaaactggatacctatgccgtcgaaatttccctgtaacggttcgttcagttctttcacttcctccagatcggaataagtagaatgagggtccagctgattcagcatacttacaatagccgtttctaccagtttgttttcatccaccttgtctacatataagtttgagatggcaaattcggccaactgaagcttgcgtgaaggagaattgagcaatttattttgtgcactcaccgagccaagcaacatcagtgtacacaaacatattaagtaaagtcgttgtttcataaaatttgtattcatcataaattaatatccagtcctttgggcaggaacggtgtcacatctctaccatactgcaataattcacgtacaatggtagaactgatagctgtcagttccggttcggtaaaaagcagaattgtttcgatgccggcaagtttccggttaatatcggcaatggtttcctcgtattcaaaatcgtgtacggtacgtatacctctaataatgaatttcgcatctcttttctgtgcaaaatctacagtcagattatcgtatgcttccacctgaatacgcggttcattagcatagagtttttttatcatttcaacacgtttctccgttggaaaccaagtctttttattgtcgttgataccaataccgataattatttcatccataaaggtcagcgcacgttccactaccgaaaagtgtccaattgtaaagggatcgaatgtccctggaaatattgctcttttcatttaagccacaatcataaatcgagaatctatcgcttttttcagctcagtaaatcctcttctattaccaaattattaataatgaagttctggcgctccattgtattctttcccatatagaactccagcagttctttcacagcatcggttttacgcaatgaaacttgctccagacgcatatccttgccgatgaaattacggaattcgtctggtgatatttctcctaatcctttgaatcgggttatttccggattcggtgcaagcttctcgatagccgcaattctttcctcgtcagtatagcaataaatcgtttcgtatactccttttttacgattgcgaacacggaaaagcggtgtctgtaatatatagacatgtcctttttttatcaaatcggggaagaattgcaagaagaaagtgatcatcaacaaacgaatgtgcataccgtccacatcggcatcggtagctacaattactttattatagcgcaatccgtccaaaccgtcctctatattcaaggcagcctgcaacaaattaaattcttcgttttcgtataccactttcttggtcaggccgaacgaattcaaaggcttaccacgcaaactgaataccgcctgcgtatttacatcgcggctcttggtaatggaaccacttgcggaatctccctctgtgataaagattgaactttccagacgtggatcgttctcctcatcctttttcgtccctttcagatcattcaggtgaatacggcaatcacgcaattttcggttatgcagatttgcctttttcgcacgttcacgtgctatctttgtcacgcctgctatagccttgcgctctttttccgactcctgaatcttctggagcaaaacatcggctacgtcgggatgcttatgcaaataattgtctacattttcttttacgaagtcaccaacaaacttattcacgctaatacccgacagtggataaggattgccgtcggaatctttttctggagccatcgtcaacgaaccgagcttaatcttggtctgactttcgaaagttggctctatcacattaatcgcaatggcagcgaccagaccgtttcgaatatcctgaaactccatgtttttaccataaaattccttgatggtacgtgcaatatgctctttaaaagcactttgatgggtacctccctgagtggtatgctgaccattgacaaatgaataatattcttccccatactgcggactatgagtaaaggcaatctctatatctccaccttttaaatgaacaataggatacagtcccggcgaagtcatattatcgttcaacaagtcttccagaccattacgactaacaatacggtggccgttataataaatcgacaaccctgtattcaagtacgtataattacgtaacatggtttcgatatattccggccggaaatgataatttaagaataaggtattatctggttcaaagaaaatataagtaccgttctcctcgtctgtagccttcgtcgtatcactgattaattctcctttttcaaaaatagcttcacgcatctgaccatcgcgtacactgcgtgcaatgaaacgagaactcaatgcattgacagctttggcacctactccattcaagccgacacttttcttgaaggcttttgtatcgtatttaccacctgtattcagcatggaaacagcatctaccaaacttcccaatggaataccacgcccataatcacgtacggaaacacgcaaattgtcttccacctgtatttcaatacgctttcccgctcccatcttaaactcgtcgatgcagttatctaccacctctttaagtaacacgtagataccatcttctgcctgagaaccgtcacccaaacgcccaatatacatacccggacgggtacgaacatgctccatatcacttaaatgacggatattctcttcagtatacgaaacgggattcgttatttgttcattgtattcttcttccataggctaacgtaaacgatagactagttttctttcttgttatctgtaatcaatagttttttataagcacgacggcgtttgtgctgaaccgcttcaaaagctccccactgtgcctgtacttttttattcaattccagttctggattactttcaccatacttgaatcccatctgctggtaaattggaaccagatcatagaacagcaaagcattaactcctttgctctgatattcaggttttacaccaaccagcaacaggtcgagcactttaggcttcttgataaacaatgctttcagcaaatggaaccatccgaaaggtagcatcttgcctttggctttttgcaaagcttccgaaagagacggcatagagatacccacagccactaaattgcccgcttcatcttctaccaacgaaaccatacgcaaatcaatcaaaggaagatacatcttaatgtattgattaatttgtccctgcgtcatttgtgagtagccgtacaaaggagcatatgcctcatttatcagatcaaaaatcttctgtccgtaattttggcttttgatctcgctccgcttcagcttctttattttcaatttatatttttcaagaataatctccgaaatacgaacgaacttatcaggtagtttatcgggtacagtcaacttaaattcaacccaatcagcctctttctcaaaccccagtcgttccatgtgctgcggataataaggataattataaatggttgacatagtacctaactgatcaaaaccttcaatcaacataccttctgcatccatatcagtaaagccaagcggaccgacaatagcctccattccgcgttcttttccccactcttctacagcattgagcaacgcttcagagacttccggtttatcaagaaaatcaatccatccgaaacgaacttcttttttcttccaagtttcattcgcacgatgattgataatagcagcgactcttcctacgacctcatttccctcataagccagaaaataatcagcttcacaaaactcgaatgctgcattttttttcgggctgaaagtattcagcatatcatcgtacaaatcgggtacggaataaggattattcttgtataattcgtaattgaagcgaataaatgtctgcaactcctttttggagcttactttcttaatgataatagccatctgttcgttatagtatgaaatttcagggggtaaagatacaattttttatccgaagagtcattcactttcaacgtttttgatgcatattcttacagcattgtcccattctttaccttatttccaaatagaatcggtccttaattgtatcctgacatgtcacttttttctatcaaaagcatgtggaaacattactcaaaaatgagtaaaaaatctacaatctttatcaagagcatcatgggaatagaatacaatatatcactacaaatcaaaagattatatatttaatctatatataaaataaaattggcgtaattattgctaaataaattacaacaaaaagaataattatgagaatgaaacaaaagtttaaactgtttttcacatttgccttattttgtatagttactcaacagctatttgcgcaaaaacgagccatctctggagtcgttacttccgcagatgaaaaagaggcattaataggagtttctatttcaataaaaggtaatgaaaatgttggtaccataaccgatgtaaacggaaaatacaccttacaggtagaacctgaccagacattgatcgtatcttatattggtatgaaaaccatggaagtacatgttccgcgcaaaaattcggtattgaatattgtcatggaaccagaatcgatgaatctagatgaagttgttgtaactggttatggtaactttaccaaatcttctttcaccggatcagctaatacactaaaggcagatatgctgaaagatatccccgtcatgagtgtagaacaaaagctgcaaggtatgacaaccggtgtcaacattacaagcagttctggtcagccaggtgccaatcaaaatattcgtattcgaggaatgggttcattcaatgcctctcaggaaccgttgttcgttatcgatggagttccggttacttctggaagccttagtgccggaggttcggatgctgcttatatgaacaactcgaagaccaatatcatgagtacactgaatccttccgatatcgaaaatattacagtcataaaggatgcagcagccgcttctctttatggttcgagagctgccaatggagtcattcttatcacgactaaaaaaggtagtgccggaaaggctcaagtaaccttgaatgtttcaggtggtttctcgaatgcagcagtcgacttccgtccaactctaaacggcgaccaacgcagggaattgttatatgaaggcttggttaattacgctatcgatcaaaacatgacatctcctaccgactatgcggatcaggaaatcggccaatatgcatacgtaccctctatgggatataccgactggcgtaaggaactcttacgtacagctactcaacaagattatgaagcctctgtttcgggtggtaacgaacgttccacttattatgcctcattaggatataataaacaagaaggtctggccaaaaactccagcctcgaccgctattccgctcgtctgaacctgacacaaaaagtcggaaaatatggagaggtaggtgccaacatgatgttcacacaaatgaatcaggaaatgaatgaagagcgaggctctgctatcaatccgttcctttgcgtggctatgaccatgaatccctcgatgactgtacgcgatgaagaaggaaactacatcggtgcatacgaaggcagcacactaaatccattacgtgatatcatgaccgactataaccgggtacgcatgactcgtatgttctctaccggatatgcaagcatagaacctctgaaaggcttaaagctgaaagaaacaatcagttatgactatactatccagaaagattcccgatattataatccgcttagttcggcaggacctaaaagtggtagtgatgcacagaccgcaaaaggatttatagaatatggtaagttcatttcatctacctcgataaattatgtgcgtacctttgcctataaacatcatttggatgtactggctgcctacgaaatagaaaactaccagaccgacaaagcctcgggtatgaagtcgaaactgccttcagatatattgactgagccagataatgcagccgtactgaacagcttcatttcttctactcaagactaccgcatgatttcttatttgtcacgtctgaactatgattacgatgaccgttactatctggccggcagcttccgacgcgatggtagttcacgcctttctcccgacaaccgatggggtaacttctggtctgtttcgggtatgtggaacattagcaacgaagcattcatgaaaccagttaaaaaggttctgaacgacctgaaaattcgtgcttcgtatggcgtcaacggaaaccagcccaattctctttacggatatatgggattatatagctacgggcagaactacatgggagcatccggctcatatgagtcatcacaacctaatacaaacttaggatgggaaaagaattacaacttgaatatcggattggattttgcttttatcaaccgtattttcgtaagtctggaatattataaccgtgatactaaggacctgctttataatcttccgattagtgcaacgactggttttaccagttacttggctaatgtaggacaacttaacaacaaaggtgtagaattcgaacttcgtacactgaactttgtttccaacgattttaactggaccaccgtattcaatcttacccataatagaaataagattgtttcgctaaacggtcaacttgaccagacaattgaagggacctggtatattcataaagtgggactaccctattatacattttatgtaaaagagtttgccggagttaattctcagaacggtaaagccgaatactataaaaatacggtcaatgaagatggaaccatcgaccgtagcctgacaaccaaccctaatgaagcggaaagcattccatacaagtcggtcaatccaaaagtttcaggtggtctgaccaacatcctaaactataaatggctggatctaagctttacacttacctattctttgggaggctattcatacgataagttaggaacaagtattgagaatggaactgaatctatttatacttccagatacaatctgccaatatatgcactggatcgctggcagcaagctggagaccagacagatgtaccccggttcgtctttggagaaaaagcaagtgtaaccaactcatcacgttacattcatagtactgaccatttaagactaaaaaatttgactcttggatttacattgcccgatcaatggacaaacaaagcgctcatcagtaaagcacgtgtttatttctccggaagcaacctgttgacatgggctaaatggaaacaatatgatccggaaactcctgtaaacggagaggtgtattgcgaggcacctcctatgcgtacattcagtttcggagttcaattaacattctaaaatcattaacgctgtatcatataatatgaagaaaatatatatttacctattgacaatggtttcagtgatgggaacttcgtgttcagaagactggttgaatctgaacccttccacatctgtcacaaccgaccaggcttttaccactttggaagatgccaaggttgcactgaatggtgtttaccgagaaacgtcacagcatagttattatggagataattactggtattacggtgattgccgcgccatggatgtacaagcaagagaaaacaaagcatccggcaaacgtgtcacgccttattatacatataatgtgctggcaaccgataacctgaatataacgcttccatggaatcgtccttatctggttatccgacaggcaaacaaccttattcaaaaaatagaacaaggagctgtacaaagcagcgacaccaaagagctgaaccgtataaaggcagaagccttagtcttacgaggactggctttattcaatctgacccgattgttcggcatgccttacatgaatgataacggtgcttccttaggagtccctatcgaactgaaaccggaagaacctgcccatcagccgaaacgaaatacagtggccgaatgttatgagcaggttgttgcagatattaccacagccttgccaaacttgcgcacagaaaaaaccgacggttacattaactattgggcagctcaagctttactttcaagagtgtatctcgatatgggtaaaaacaaggaggcatacgatgctgcaaccgatgtcatcaacaacaacggaggattgtatcaactctatacacgtgatgaatatcctactatatggggtaaagattttcagtcggaagcactctttgaactctatatcagtacaaccgaaccttcggaatggggcggcggtaccggtggtgaaggagccccgatggtttacgctaacgaagaaaaaggagtcgactggaacaatcttattcttacagaagaattcttaaatctcttggatgaagatccgaacgatgtccgtcactgcattacacagttatcattgattgaaaataatgaaggtctgcccgaagcagctcgcaaccaaaaggttttcctcggcaagttccccggaaagagcggcgacccgaaagataataatatcagtgtcatccgattgtcggaagtatatctgaatgcagccgaagcaggtgtaaaattaggaggtgaatacttggaaccggcaagaggcttcctgaatcagatcgttagtcgtgccaatccggataaatctgtcagtgcagccgaattcaccatcgaacgagtattgaaagaatgccggaaagaactggtcggcgaaggacaaatcttcttcgactatctgcgcaacaagcaaccgattgtccgtaagggtggatggcatttaagtacactgagtacattgaacgcggaaacgattcaacccaacgatccccgcattgctctccctattccacaatctgaaatagatgccaaccctaacatggaacaaaatccacaataagactttacattattatcataaaccttaaaaaaatccgtttcaggaaactttagttatcttgaagcggattttttattgttttactcaaaagagcataaaccaaaaagggaaatatcagatatttttctatttcgaacgtaaacacgcacaagatttcacaaacaaaaagatagataaaacagtattataatacaaaataaatagcataaaaccaatacaacaagcgaaaaggcgatttaaagcctaaataaacgacaaatagagaaaaaggcaaactattcataattcacgaaaaagtatcaaagctgagctcctccccgattttttcaaatctcagagggttacttccaccagtttgttggcaaggaaagaatcataccgataacctgcgcatagtttttctgaccagaaggaatctgattacttttcaagtaccagttataaaccacattctgcaatttacctaataatttgttataacgatcatcccagtatgcttccttatcatataattgttttattatctccggacggattgtatcaagccagctcttaaactctgtttcactaagcaacccacgagtattgactactacataaggcagcaatccaaagtagccgctatatcgtatacccgcatcagtagaatgaatacaaacttggtaagcccagaaattggcttccgcttcactgctcactcctaacaaatgggcaagctcgtgcgcataagtaaaaggaagttgaacggggagcagttcatgattcacatgcgattcatcgaaaaacggtcccatatatcctaaaacaccaacccctgaatacaacacattacagaaagaacgtttcggatgttgaaaatcttttggacgaatcagtccgtactttccgggtatttttgcgtaaaccgatttgatggcttgttccaaagcaggtagtgaaacatatatctcttgactaaatgcagcattcaggctatctgtgtacgccgaaaggaattgtttgaaacgttgttcttcataagcgcaaggtgtaactcctgcccgctcaaaaaagtcattgcgaaagtagttgattccccagccccaataaaaccaaacgtacatccataacaaaatttccacttcagtaacagctatccacctccatcttctatttctacgcctggcaataaacggataaaccagcaaacatacaagcgttactatcaccaaaacttcacaaagggaaaatgggaaccaggaagcaatccgagataagcaggaggaaattaccggataaatagaacgagcgtaaaattcacctgtaccggatacaaaccgaaacagaaatatactcatcaaaagtaaaacgagtattatccaacgaatatatttccactgaagttttttcataagaacaaagttatcattttctgaattaattctttacttttgtccggtaaagattattaatacttcaaacagacttcacatggttttaaattatatttggattgcttttttcctgaccgcatttattgttgcagtcgtacgcctcttgtttttaggagatacggaagtctttccagccattatcaattctacgttcgattcatcgaaaacggcctttgagatttctttgggacttaccggcgtattgtcactctggatgggtattatgcgtatcggagaacagggaggagttatcggattattctcacgcctgttaagtccgctatttaccaaattgtttcctgagattcccaagggacatccagtgacaggaagtattttcatgaaccttgccgccaatatgttagggctcgacaatgctgccacccctttggggctgaaagccatggaaggattacaagagctgaacccaaagaaagacacggcaagtaatccgatgatcatgtttctggtattaaatacttcagggctcaccctgattcctatcagcatcatggtatatcgtgcccaactgggagctgcccagcctacggatgtattcgttccgattctattggcaacgtttttctccacacttgccggtatcattgctgtaagcttgtaccaacgtatcaacctactgaaccggacaatcctcttgttcttgggtggcacaagcctcgtgatagctggaatcatctatttcttcagtacattgtcgcgccagcaaatcgatatctattctactacgacagccaatgtatttctgttcgtcattatcatcggatttatcgtagctggcatgcgaaagaaaatcaatgtatacgatgccttcgtagaaggagccaaagaaggctttactacagctgtacgcataattccatatctcgttgccatattggttgccattggtgttttccgtgcttccggatgtatggactatttaatagaaggcatcgccaaactcgtcaatttatgcggcatcaatagtgatttcgtgggagccttgcctaccgcactgatgaagccgttaagtggcagtggggcgcgcggattgatggtagatgccatgaacacgtatggagccgactcattcgtgggacggttatcatgtattttccaaggctccaccgatacgacgttctacatccttgctgtttattttggaagtgttggagttgtccgtacccgccacgccgtcccctgcggattgcttgccgacctggccggaatcatcgcagctatttttatttgctatttattctttaactgatatagatatgataacttatcaaacagaaggggtagaaatgcccgctatcaagaaacgcgaaacgactgcctggattaaggctgttgccgaaacttatggaaagaaggtaggtgaaatagcctatattttttgctcagatgaaaagattctggaagtaaaccgccagtatcttcagcacgattattatacagatatcataactttcgactattgcgagggaaaccgtatttccggcgatttatttatcagtcttgatacggttcgaagtaatgctgagcaattcggagctacctacgaaacagagttgcaccgggtcattattcatggcattcttcatctctgcggaataaatgataaaggtccgggagaaagagaaatcatggaagcagccgaaaataaagcactcgatttactaaagaacttccaataagctcacggcatctatcctttcaggaaaaggatcatttgtcttctctgtcttcaggagccttaaagtttccgccgtcgtttctttcaattcatggagatgtttttctaaaccatcgccacaaattaaaagggacgacggcggatttcattttattctttcaaaaacagctaccctcttattccttccccctccggctataactctttttacgaactgaatctaagctaagccactaatttttcgtatttttgcaccagatataaaaacaagagattaatggactttaagtatgacgttattgttataggagccggacacgccggctgtgaagccgccgcagcagcagccaatctcggatcgaaaacatgtctgataacaatggatatgaacaagatcggacaaatgagctgtaaccctgctgtaggaggtatcgccaaaggtcaaatcgtcagagaaatcgatgcactgggaggatatatggggttggtaaccgaccgtaccgccattcagttccgtatgctgaaccgctctaaaggaccggccatgtggagcccccgtgcacagtgcgaccgtggcaaatttatctgggcatggcgtgaagtactggaaaatattcctaaccttcatatctggcaggataccgtagaagaattactcgttgagaacggtgaagttaccggactggtcacttgctggggagtaacctttcatgcaaagtgtatcgttctgacagcaggtaccttcttaaacggactgatgcatatcggtcacaaaatgcttgccggaggtcgctgtgcagaacccgcttcttatcatttgacagaatccatcacccggcatggaatcacagccggtagaatgaaaacaggtacccctgtccgtattgatgcacgaagcgtagacttcagtctgatggaaacgcaggatggagaaaacgactttcaccgcttttcgtttatcagcgaacccagacaactgaagcaattgcagtgctggacatgttataccaacgaagaagtacatgaggtattacgcagcggactggcagactctccccttttcaacgggcagattcaaagtatcggtccccgctattgtccaagcatcgaaacaaagattgtaacattccccgacaagccgcaacatcagctattcctcgagccggagggagaaacaaccagagagctttatctgaatggattctcttcatcgctgcctatggaaattcagtttgcagccctgaagaagatcccttgcttcagaaatatagtagcttaccgtccgggatatgccatcgaatatgattatttcgaccctacccagctaaagcacacactggagtcgaaaatcataaagaacctgttctttgccggacaggtcaacggaacgaccggatacgaagaagcaggaggacaaggaatcattgcaggcatcaatgctcacatcaactgccatggaggtgaacctttcgtattaggccgcgatgaagcatatatcggcgtactgattgatgacctggtaacaaaaggagtagacgagccttatagaatgttcacgtctcgtgccgaataccgtattctacttcgtcaggatgatgccgacatgcgactgacagagcgctcctataaattgggactggcaagcaaggaacgttacgacagactttgccagaagcgtgaagaaatacaacggttggttgaatttgcaaagacttactcaatcaaggctgataagataaacgacgcgctggaagaactcgggactgcccgactcacccatggctgcaagttaatagagttacttagccgcccgcaaatcacgatcgaaaacatagcgccacacgttcccgcatttcaggctgcactcgacaaagtgaccgaccgtaaagaagagacgatcgaagccgcagaagtattgatcaagtatcaaggttacattgatcgagaacgaatgatagcagacaagatacatcgtctggaagctatccgcatcaaagggaaattcgactatgccagtctgaattcactttcaacggaagcccgccaaaagctgataaagatagatcccgaaacattggcgcaagccagccgaataccgggcatatcacctagcgacatcaatgtcttactagtcctgttaggacgataagcaagcgtgtttcacgtgaaacaactagtttaagaaacgaatataaattactggatatgaataaagaaacattaaagaaaaaccttcgtgaaatacccgatttcccaataccaggaattctgttttacgatgtcactaccctgtttaaaaatcccgagtgtctgcaaggcatgatagacgagctctatgagatgtacaaggacagagaaattaccaaagtagtcggaatcgagtcgagaggctttatcttaggaggagcactggctgctcgcttgggagccggttttatcatggcaaggaagccgggcaaactgcccgcagaagttgtggaagaaacctacgccaaagaatatggaactgacacaatacaaatccataaagatgcgatcaatgaaaacgacgtagttctgttacacgatgacttgctggcaaccggaggaacaatggcagctacttaccgcctagtaaaaagatgcggagccaaacaggcattcgtaaactttgtaattgagctgggagcattaaacggaagaaaagcatttgccgacgatgtagaagtaacaacgctattgcagctttaagaaatactcttttacccgttgggtagaatcacaaaacagaatccggtacatacgaaaagcgtctaccggattctttattttataacctctattcataagcattgctaatatggaagaactgagcacaaacgaatatctccgaggaattgtattaaacctgccaagcagtccgggtatttatcaatacctgaacaaagaaggtgtgattatctatgtaggcaaagcaaagaatctgaaacgacgtgtatactcctatttttcgaaagagcaccaatcagccaagactcgtgtgctcgtcagcaagattgcagacatccgatacattgtcgtcaatacagaagaagatgccctgctgctggaaaataatcttatcaagaaatacaagcctcgctataatgtgttgctgaaagacgacaagagttacccttccatctgcgtaagcaacgaatattttccacgggtattcaagacaaggcagatcattcgaaacggttcaacttactatggtccctacagccacattccttccatgcaagccgtactcgacctgataaagaaactctaccctcttcgtacctgtcatctggcccttacttccgaaaacatccggcaagggaagtttaatgtttgtctggaatatcatatcaaaaactgcaaaggcccctgtatcggcatgcagtctcacgatgaatacatggagaatatcgctcaagtaaaagagattctcaaaggaaatacgcaagctatcagcgatgccttgatgaaagaaatgatgacattggctgaagatatgaaattcgaagaagcgcaaaagataaaggagaaatacgagctgatagagaattaccgttcaaagagcgaggttgtcagctctgtccttcataacatcgatgtattttcaatcgaaatggacgacaacacagcctacattaattatcttcatattaccaacggttgcatcaatcaggccttcacgttcgagtataagaagcggctgaacgagaccaaagaagaattgcttcagctgggaataatcgaaatgcgcgaacggtacaaaagttgttcacgcgaaatcatcgtaccgtttgaactggatatggaactgaataatgtcacctttacaattcctcagcgtggtgataaaaagcacctgctggaactgtccctactcaacgtaaaacaatataaagtagaccgtctgaaacaagcggagaagctgaatccagaacagcggagtgtacgactattgaaagagattcaagagcagttgcaaatggataaaatgcccgtccatatcgaatgcttcgataactccaatatacaaggatcggatgccgttgcagcctgcgtagttttcaagaaggcacgccctagcaaaaaggattaccggaaatacaatataaagacggttgtcggaccagacgattatgcctccatgcaagaggtggtacgccgtcgctatacacgtatcctggaagagcacggagaattgcccgacctgatcctaaccgatggtggtaaaggacaaatggaagtcgtacgccaggttatcgaggacgaactgaaactgcatattccgattgccggtcttgccaaaaacagtaaacaccgtacatcagaagttcttttcggctttccacccatgacgattggtataaagcagggcactcccctgttccatcttctggagaacatacaagatgaggtacaccgttttgccatcacgttccaccgtgacaagcgcagcaaaagccaaattgcatctgccttggataacataaaagggattggtgaaaagcgtaagacagcactactgaaagaattcaaaagtgtagctcgaatcaagaaagcgacactcgaagaactggcggcagtagtaggcgaaagtgcagcacaaagcataaaagaatcgctctaagtttcttttctgataaattatctttctgttccccgactgaaaagccaaaagaagattttcccatcgtcaacaagcaacgttttcagccgttattcggactggaaagagcctcctgccgatgggctacagataaagaaacatgccattggaatcaagtctggttagaaatagaaaagctctgcaaaaagataagccaaatctttccgcagagccattgccactattatcaataccactcatttcatcacccaaactcctctaattccgataccacaaagatacaattaatttcggctagacttttgtcattctttcaattttattctattattgtactgaatatttcctatctttgtagaaagtatataccacatgagagtagtaattcaacgtgtaagccatgcatccgttaccataaacgggacatgcaagtccgccataaaagaaggctttctggttctggtaggtatagaggaagcagacaaccaggaggatgccgactggctatgtaagaaaatcatcggattgagagttttcgacgatgaaaacggagtaatgaacaaatccatcctcgatactggaggagatatattagtcgtaagtcagtttaccctgatggcttcaaccaaaaagggcaatcgtccttcgtatattcgtgccgcccgccatgaaacagccattccattatacgaatatttctgcaatgagctgagcatcggcttaggaaaacaagtaggcaccggagaatttggagccgatatgaaagtagaactattgaacaacggccccgtaaccatctgcatggataccaaaaacaaagaataatatgacactggaagaagcacaaaaaacggtagacaactggattaagacatacggcgtgcgttacttcagcgagctgaccaatatggcagtactgacagaagaagtaggagaactggcacgtgtcatgtcacgcaaatatggtgaccagtcatttaaaccaggagaaaaggataatctcgacgacgagatggccgatgtattatgggtactgatttgcctggccaatcagacgggtgtagatctaacggaagcattccggaaaaatctggaaaagaaaaccagccgagataaggaaagacataaaaacaatcccaaattataaacattatgaagtataatcacgatcacgaatgtggatgtggcaacgaacatcatcaccacagccacgaatgtaactgcgagaacgaacatcatcacgaccacgaatgtgaatgcaactgcgacgatgacgcttgcgactgcggatgtgaagaagaggataaagaacacctgcatcagccaagcaaatacgatgaagcattgagcaagtacaacaccaatctgaaagatgaagaagtagctgctcaaactgcccatatcatcgagaaatacgtaaaggaaaacgatacgccggaagttaagaaattccttcttcattgcatcgacctgactacactgaaatgtacagacagcgagcccagcgtcatgcagttcacacagcatgtcaatgacttcgtagatgcctatcccgaacttgataatgtagcagccatttgcgtatatcccaacatggccgaaatcgtaaacgataccctggaagccgacaatgtaaacattgcctgtgtttcgggaggattcccttcttcacaaacgttcatcgaagtaaaggttgctgaaacagcgatggcaattcatgctggagctgatgaaatagacattgtaatttctgtaggaaaattcttgagcggtgattacgaaggtatgtgcgacgaagtagaagagctgaaggaagtatgcggagacaagcacttgaaagtaattctggaaaccggtgcactgggtagtgcctcaaacatcaagaaagcctctatcctgtcaatgtattcgggagccgacttcatcaagacttctaccggaaaagaaaatccggcagctactcccgaggcagcatacgttatgtgccatgccatcaaggagtacttccttgaaaccggccgtaaagtaggttttaagcccgctggaggcattaacaccgtgcatgacgcactggtatactatacgatcgtaaaagaggtcttaggcaaagaatggctgaccaacgagctgttccgtttgggaacaagccgcctcgccaacctgctgttgtcggatatcataggcaaagaaaccaagtttttctaatttaaactggtgtttttacccttcacgtccttcaccgggcggagggatttaataaaagggcacgaagattcatattggatatgtttctccgtgccctcgatctttatgtaacctcaaactctaattagccacaagccttccgttttcccaatgctgatttaagataacaggaggagctgtcggtttatattttgtctgcgacggcatagtacgtgaacgtccctgccggctcaaatcccagctgacgaacgtttcataatcaaactgccagctttcaccgtaagccaatttatgaatacggttgtaaatcgcctcccgcgaaggagcattgaagcctcccacattgcctaccatgatgctggtttctgtaggacgatatgcccccttatagtacgtacaagcaccttcataaactccaaggccttcgcttgcataacgagaatcggatataaacttgctccataccacactgttcggatcgcttgtatagtctacattccttccccatccgtaacgattacgaaaatctatatttctagaaatttcactcgaaggaattgtccctttgctctcataataatattcatcttccaatttagcgaatccatgtcctccagcttcgtggtgaagcacacttgccaaatcttcatcactcgttcctatcgggaaatatgcaatgccatatcccctgccataatctccctgataagctgaacttgatccccaatagcaggttcctgcatatagagtcgaattcatcattacaataatcaatacctcattcatcagcggatcggtcattcccggacaagtagccgcatactgcatgcacttgttgtcatctcctcctacgtgagtccctccactaaaatagccggaaaataccgtactacctccgtctacgtatccttcatttttggaaacagccgtcacataatacacgttaaacaagttccggaaggaagtataaggctcttcactgaagaaagcatcggctgctgtccgcataacctcctcataggtaccgtcggcaatctgcctgtcggagaaagcatctcccatcaaaaccacgttgatgccgtttccttctgaagcttgctgtaaggtatatacctttccgtcctccgaaaaatcggaagattcgtacggcaaatctccctcacccaggattcctttcaggaaatcaggaagcaaacttcttgatgttacactgctatggaatatcagcttgcccgtttcatcgaaagccatgattgtagggaaaccgctatatgaaatacctccaggattggacatcagcgtaggccattccatattgttgctttctattgtattggctgcatctacagggttctctgttccatcgctacaaagcccgatgatttccaatgaatggttcttgtaacgctgataaattgacgatactgtaggatggaaggccttgctaaagctacaccatgaggcccaaatataatacaacgtcactttatgagaggcaacgatggaactggaatttattgtatttcctctataatcagttgcggtaaaatcgggcatatacaagttaaatgtatcgaaattaaatccgcccggtgagttttgttcgatacaaacccagccactcttctgccaccaggaagaggatgtaacaacctgcggcagatcgcctgacagcatattccctccaaagtccatatattccagttctgtcaagtttccaagggtttcgggtacagtacctgtcaactgattatcatccaagtagcaataggccaattgcttcatattccccaattcaggtggtatactacccgtcaattgattccggtataaatataaaccccgaagtcttgtcagcttaccaatagaagcggggatttctccggtcaactgattatagggcacattcaatatccatagcgcttcaagatttccaatctcatccggtatggttcctgtcagattgtttgaagacaaattaattgaacttaccttaccattattgtccatagaaataccataccattccgacaaatcagcatccgtacaccagttcgtattattcgtccatgcatcaccgtttgtagcatcgtacaatgcaatcagagcatctctctctgtcatttcatcctgttccagcagattgtcggtatcaacagccaagaaactggttatcacagaacgtcctacggtaatgctacgctctgtggccttggtaagcgtccgctgctgaccgtttacatatccagtaatcttaaatgtcataccgttactgaatacctgaggaggaactacaaaataaaatgaggtagcctgcgaaggagataaggttctggtgcctcgaagtacgatttcactggcactctcctgccctcctccagaaacacggaattcaggcgcatcggaggctatatctaccgaaccccagccagcaacagcttccccgttattacccgacaatgaaagagatgacacctgcatgtttcctttcaagttcaggcgtaccagtccgcaaatctgtaaaaagtggaaagagtttgtagtactctgagccaccatcggacatataccggaagcaaagctatcgaaaccgaacggctgttcttccgacagacggaacgaaacgctcgtaccagatactacagcatcagccgcatacggataaaaggcataaaatgtattacctctgataggcttgtcgctttcaaactgtgcctcgtcgcctgagatttcagtcaggtcgtaacgggcaaccgaatcggatgtattgctgaaaataccgatggcatctcccgtattccataccacagaattaccagaaagagaagtacgactctttacaattgccgatgtcgtagcacgaaccgatttcaaactattatcctgactgccggaaggtaccagttcatcttgctgacaccctacaagcaacaacaaaaatatgcctaaaaaaagagttatatgcttcataatttactgtgtttttcaagattattaccagtcttcttcattctctataaagtcttctatgctgccgcctgctgaaggagtttcttcttttttaccgtcttgagtaatctcaataacacgaacaagctcctcagcccgaaccgtcacacttccctttcgctgggaagtagaagtattggctgcaacaacgatgatatttccctctatattgatccagcccgtatcgctgctggtcaatgtatactgggtattactgtttacagtgaaggcgaatctgcctccttcggatgctgcggaaatgctcgaaggagatacttccagatacacagcctcaccctcttgaatcacacgtaccgtacggaccagactaccgtcttccgaggtgaccgtgatggttccctcacgcgatgtggtcgattcgttggcacttaccgtaaaggtcggattcttccattcacccacgccagccatgtcactgctcagccaggaagcactgctcgacaagcggtaacgggtattggtttcaactgacaaagtcaatgtctgactgttgctcgtcagagagaaagaagacggacttacgttcaagatcagttcttccctgccctcttgaacgacccgtaccgtacggaccagactaccgtcttccgaggtaaccgtgatggttgcctcacgcggtgtagtcgattcgttggcacttaccgtaaaggtcggattcttccattcacccacgccggtcatgtcactgctcaaccaggaagcactactcgacaagcggtaacgggtattggtttcaactgacaaagtcaatgtctgactgttgctcgtcagagagaaagaagacggactcacgttcaagatcagttcttccctgccctcttgaaccacacgtatcgtacggaccagactaccgtcttccgaagtaactgtgatggttgcctcacgcgatgtggtcgattcattgggtaatattgtaaacacaacctcttcttccgcagcccccgacaacgtccgagtcatccagtctactcctgcactcacctgataaggtacatttcctttcaccataaaacgaaccgtaccaccttctgcctgaatatcgaaataatcctgcgaaacaatcagataaggagcttcttcctttcctttttgcaataccttcaccatacgttcaaccccattgcctgtcacgataatatagccttcacgcatcaccgattcggtattctcttccacactaaaatataaagttgactgttccagtcccctgcctgctacttgcttcagccaactgacatctgtctttaccgtataactgatattggcactgacctcgatggaaaaggttccccccacagcctcacagatgataggatctgaagaaaccagaatctcatcgacggcatactgacggatggtaagcgtatccgatacagcttccgtttcatcaatgaaaataaaacgtgcctcacgcatatcgtatgtatcattgggctgtacctcgaaatgcagcgtatgggtagaaactgctctcgaagccggttcactcacccatgtatactctgcttcgggcttacagatatacgaaacattcgactgtaactgtacgtctaccgtaccacctccggcaccaacttcaatcaagtcatctgaaagaagcaatacctccttttccttaccttcctgataaatatgtaccgtttctcgcagttctccgctactgattacgatacttccacttcgtttgtcgtaaccgtcgttagccaatatacgaaaagccagcaccgatttttccagactccgtgtagagatttgctcaatccatgtatccgaggtttctacttcaaaggcgacatttgcctccacttccacttctatctccgactcaccggcaggaagctgatagctttgctgcgaaacaatcaatgcatctttctgcttttgtgaaacgacaatcgtttccctattgtcgccacactccaggaaaacggaagcactacgttcgtccgtaccttcgttagctgctaccgaaatggcaaccgatgcctctccctgttttccggaaactggagaaactgtaacccatcccgtagcacgcacgttgcctattgtagccgtccagtcggccgtagccgtaaaatgtactgtaaccgttccaccagaagcatccagtaatggattcgtatcagttccttcggctagcgtaatcttggcttcaggagtttcaggttcatcgggtatcgtcgctttctcttctccagtacaagccgacaataccaacaagagtacaaacagagctttctgcatcatttgcatcttactccaacggaaagaatcgttcatagatttaagatattaaaaatgtgaaaactttttcagtaaaaacaagatagcctatcgtcgcttaaattatacattttttatcaaacatcaaagttttttatcacattttctttacatataataaaaatagtatacattaattataaagtactaatagatatatttcattttatataaaagaaatacaagaaacgaaaggcaggctaaagagaggaagaagtattagcaagaaaattgacacattatctcagctatttaccaaagacatgtagaagagataatgtaacagaaaattatcttcaagtaaaatattggtgaaaatatcaggatattttttccaagttatatacagaaatgcctgaaaacatctcgacattttccgaaaatttgtacaaattccaaaatcttttgtacaaaaaatatccctttacccatagtgtctttactgaaaagacaacacataagtaaaaggatatctctatgtggtcacctctctcttttgaaatctatattacaaaaaggaacggaggtgttatttatttcgctcaatcacataatcaatataagcagtaagtgccgcacggatagcttcatcagccgattcaggaagcaaagccagcgccttattgcggtagtcgtacatcaccttttccgcatagacgatacctccctcctgctttacataatctacaaaaccagcaatttcttctttcgacgcactaagcgaacggatgcgtaacgccaattctttctttgcttcatcggcacaggcattcagtacatgcagtgccggaagcgtcagcttaccctccatcatatcatttccggtaggcttgcccagctcctcattgtcgaagtaatcgaagatatcatcctttatctgaaaggcaatgccaatcatctcaccaaaaagagctgccttttttatttcatcttgtggagcatttaccgagatggcaccactttctgcacttgccgtaaacagtgctgccgtctttttgcggataacgtcgaaataaatctcttctgaaaaatcgtgattgctgatgttcaccaactgaataatctccccttccgataagttctgtcccaagcgggccacaagctccaccagatcaatatgtttggtatacgaagcatgacgcagactggttgccagcatatagtcgcctaccagtacagataccttgttatcataaagtgcatttaccgatgattgtccccgccgcttgttactttcatccaccacatcatcgtgtaccagactggcagtatgaagcagctccagtgacaatgcagcatgtaaggtggaatcgtttaccccgccataaagttttgccataagcaagaccaaaatgggacgcatcatttttccattcctctgtttgatatagcctaaaacttcattcaataacggagtggaacttgtcagtgaggcgtcgaaaagagccttaaattcgcttaattccttttctacgggttgcttgattacttctaacttattcatggagatttatttgggtacaaaagtaataataaaacagcgaatacggtatttttttgtacttttacatagaaaacttaataattttacacgaatggagaaactatttctactcgatgcgtatgcactcatctaccgtgcatactatgcttttatcaaaaatccgcgtatcaactccaaaggtttcaatacatccgctattatgggattcgtcaatactctggaagatgtcctgagaaaagagaaccctacccatatcggtattgccttcgatcctgccggaccgacgttccgccacgaagctttcgagcagtataaagcacagcgcgaagaaactcccgaagttattcgcctctctgttcctattattaaagatattatccgtgcttaccgtattcctattctcgaggtacaaggttacgaggctgatgatgtcatcggaacacttgcaaccgaagccggaaaacagggtattaccacgtatatgatgacacccgataaggactatggtcagctggtgtcggaaaatgtatttatgtaccgacccaaatatggcgacaaggagttcgaagtaatgggtgtaaaagaaatcaaggccaaattcgatatcgaatcacctttgcaggttatcgatatgctgggactcatgggtgatacggccgacaacattccgggatgtccgggagtaggcgaaaaaacagcccaaaaattaatcgcccaatttggaagcatcgaaaacttgcttgccaataccgaccagctgaagggggctattaaaacaaaggtggagaacaatcgcgaacagattactttctccaaattcctggctaccattaaaacggatgtcccaatctcactcgacatggaagcgctgaaacgtgaacagcccgacgaagaggaactccgcaaaatttttgaggaattggaatttcgtaccttgttggaccgtattctcaaaacggaaaagaaaacagcggctccggcagcctcttctcaaagcgatctctttggattttttacggacgagaatgcaggcgaacaaaaaaattcaaatctcacgcggttagaagatctgaattttgactatcaacttattgattcagaggataaaatagacgaattattacaaaatatcgttacaaaagattttttcagtctagatacggaaactacgggaaccgatccgataaccgccgaattggtaggaatgagcttcagttttaccgaaaatcaggcattttatgttcctgttccggcaaaccgtgaagaagctttgaaaattgttaataaatttaaatcagttctcgaaaacgaaaaaacgctgaagatcggacaaaatataaaatacgatatgctggtattgggcaactacggtgttgaagtccgcggtccgatgttcgataccatgattgcacattatgtactccagcccgaactgcatcatggtatggattatcttgctgaagtctatttaaaatatgaaaccataaaaattgaggaactgataggccctaaaggcaaaaaccagaaaaacatgcgcgacctccctccttcttcggtctacaagtatgcgtgtgaggatgccgacgttacgttgaagttaaagaacgtactggaaaaggaactggtcacaaacggtgtcgacgaattattccgaagtatcgaaatgccactggtgccggtccttgcctatatggaacgcaatggagtacgtatcgacacggaagcactgaaagaaacttcccgacattttacggcacgcatgcaacaactggaagaagaagttcatcagcttgccggcatggagttcaatatcgcttctcccaaacaggtcggcgaagtgttgttcgaccgtctgaaaataacagacaaggcgaagaaaaccaaaaccggacagtatgttacttccgaagaagttctggaaagcctgcgcggcaaacatgagattgtagggaagatattggaacatcggggactgaagaagttactgggtacgtatatcgatgcccttcctttattgattaatcccaaaaccgggcacatacatacttcattcaatcagactgttaccgccacaggtcgactcagttccagcaatccgaacctgcagaacatccccgttcgcaatgaagacggaaaggaaatccgacgggcatttattcccgatgaaggatgtgagttcttctctgccgactattctcaaatcgaacttcgtattatggcacacctgagtggagaccctcacatgatagaagccttccagaaaggacaggatattcacgcagccactgctgcaaaaatatataaggagccgctggaaagtgtcacgcgtgaacagagaagcaaggcaaagactgccaactttggtattatatatggtatatcggtattcggactggcagaacgattgaacattgaacggaaagaagccaaggaactgatagacggctatttcgaaaattacccgcatgtaaaagaatacatggataaaagtatccggctggcacaagaaaaaggttacattgaaacaatctttaaacgtaaacgctacctgcctgatatcaattcacgaaatgcagttgtccgcggatatgccgaacgcaatgccatcaacgcaccgatacaaggaagtgcggccgatattatcaaggtggcaatgatccgtatctacaaacggttcatggaagaaggcattcgctccaaaatgattcttcaggtacacgatgaattgaacttcagcgtcgtgcccgaagaaaaagaaaaagtgcaacaaattgtgatatctgaaatggaagctgcttacaaaatgaaagcacctttgcgagcagactgcggttggggtaaaaattggttggaagcacattgacacggttaaattgttaacaaatctttaaatgctaacaaattgctaaaatattcattttttcttatcgaaaagttagcagcatcaaaaggttttactaactttgcagtgtaattaaaaacaaaaagatagtaacaccttaaaatttaaagatatgaaaaagatgaatttactcaagagtttatttgtaacagtatttgtttttgccgctaaccttacagtttttgctaacagtccggaaactgaactgatatacaatactgaagaaatagatggagtaaagatgtctgaaaccgtctacaaaatgaatgaaggtattctgacaaattttgaaaaatataactataagtacaacgaccagaaacaagttgttgaaaacatactgcaaaagtgggacgcaagtaagggagaatggcgtaacaacatgtgtatcaaatatcaatacaatgaagggagcactactatccaatactataaatggaatgaatcaaagaaagattatattcttgttccgcagatgacagtaacaatgaatatgtaaaaactgcatacaaaaaaaacaatattttcataaactctctaactttaagaggcacctcgtgagaagcgcctcttttttgtttatcttccagctatatctgtttttagcctatattataacaatttgttactaaaatttcgttccattctgtttcaaaggaacaacaactaatctttccttaactacgatacatttctgaaaatatccattgttttagcaaaagacaaaaagaatgactaactttgcaggctgaaaaagactgataattaataaggaaataatataagcttatggcattacaatgtggtatcgtcggtttgcctaacgtaggaaaatcgaccctttttaactgtttatcgaacgcaaaggctcaggcagccaacttccctttctgtacaatagaaccgaatgtaggcgtcatcactgtaccagacgaacgcctgaacaaactggcagaactggttattcctgaccgtatcgtaccgactacagtagaaattgtagatattgccggattggtaaaaggtgcaagtaaaggtgaaggcctcggcaacaagtttcttgcaaacatccgtgaaacagatgctattcttcatgttttacgctgtttcgatgacgacaatgtaacacacgtagacggtagtgtaaatcctgtccgcgataaagaaattatcgatacagaacttcagctcaaggacctcgaaacaatagagagccgtatccagaaagttcagaaacaggctcagacgggaggcgacaaagtagcaaaacaaacttacgaagtattggttcgctaccgcgacgcactgttgcaaggtaaatcagcacgtaccgtacaattcgaaactaaggatgaacagaaaatcgctcacgatttattcctgctgacttccaaaccggtaatgtatgtctgcaatgtcgacgaagccagtgctgtgacaggcaacaaatacgtagaacaggtgcgtgaagctgtaaaagaagaaggtgccgaaatcctgattgtagctgctaagacagaagccgatatcgccgaactggaaacatacgaagaccgacagatgttcttgcaggaagtaggattggaagagtcgggtgtaagccgtctgatccgttctgcttacaaactgctgaatctggaaacttactttaccgccggaaagatggaagtccgcgcatggacattccacaaaggctggaaagctcctcagtgtgccggagttatccacaccgacttcgaaaaaggctttatccgtgcagaagtcatcaagtacgacgactttatcaaatacggctcggaagctgccgtacgtgaagcgggtaaactgaacgtagaaggtaaagattatgtcgtagaagacggagatatcatgcatttccgcttcaacgtataatacatcatacaacattcctataaatcggtcaccgcctggtgtccgatttatttttttaaccctaaaaaccataaaccatgaactatctgattataggtaccggcggtgtgggaggaagtatcgccggatttcttgcactggcagaaaaagaagtgacatgtatcgcacggggaaagcatctcgaaagtatccgcaaacacggacttcacctgaaatccgacctgaaaggggaacattacttgaaagtaaacgcttgtacggcagaagaatatcagggaaaagccgatgtcatctttgtctgtgtcaagggatattccatcgactcggtcaaagaggtgatagaacgtgccgctgctcctcatacactggtcatccctatactaaacgtttatggtacggggccacgtatcggacgcctcactcctggggttaccgtactcgacggctgtatctatatcgtaggctttgtatccggagagggagaaatcacccagatgggtagtatcttccgtctggttttcggagcacggccggaacaaggtgttgcccgggaacgcattgaagctattgccgaagatatcagaagttgcggcatcaaagtcgatgtttccgacgatattaatcgcgatactttcatcaaatgggcatttatctcggccatggcatgtaccggtgcttaccacgacgtcccgatgggggaagtacagcacgaaggcgaagttcgtgatacgtttatcggattatccaacgaaagtgccgccatcggacggaaaatgggcattgcttatccggaagatcctgtagcctacaacctgaaagtcatcgacaaactcgatccgcacagcacagcctcgatgcagaaagatcttgcccgcggacatgaatcggaaatacaaggtatgttgttcgatatgattgacttgggagaacgattaggcattgatatgccaacctaccgaaaagtggctctgaaattcaaaggaaaatgatgatctatacgcaacaggaagctggaacatgcctgttgcactgaccgtcagccatgcgtttgtcgacggagcacatatctcgcttttcttcgagaaaatagaacaatacctcaaagaaatcggccagtaacctacattcataaaacaaacaggaccacagcaattccatagcctagagccgaagacccattcttcgacagacttctcagcttgctgcggtcctgtttatcaattccagcttattcccgattcaggtaatcgcataatttctgcgttgcccgtgcccggtgactgattttattcttttcttcatttcccatttcggcaaatgtttcggtatatccttcggggacgaacaccggatcgtagccaaagcccgaacaaccgcgttttttttcgattatttcgccttttaccatgccttcgaagagatgttccgttcctccctcgatcaggcaaatagccgtacgaaattgcgccttacggttggacttgccttccagttctgccaacagctttttcatgttggcttccgagtcgtgtccttctcctccggcataacgtgccgaatacaccccgggagcgcctcccaaagcctcaacctccaggccggtatcatcagcgaaacagtccaagccataatttttgtaaatatattctgctttcaatgctgcattcccctccagtgtatctgccgtttccggaatgtcagcctcgcaatgaatatctttcaaactcagtacttcgaccttatctcctaagatggcacgtatctcgtccaacttatgagcattgttcgtagcaaaaaccaatttctttttcataatcaatattatactatcattttccgcacaaagatacatatactcaggcaaccagccgctacttcatgccacctattttctgtgtacctccggcaaggcaagcctctctcctgtctatataaaaaagcccggcttccttaccggaaaccggacccttagtgtgtagcctatattaattcaaaataatttcgtctacaaataaataacccgtcttgccttttcctccatgccatgccggaatactcttttccgacagcgcttttactttgacataacgtgcctttaccggagtgaaagtcagtgtatgctcatatacctgattcggatctgtttccttcataaccggataagtttccgaagccacctgcttgaaggtctggttgtcatccgatacttctaccgaaatacctctggcatcgaatatccagtcacctttctctacacaagtatataaggtcatcgaactgatctctgttgcctccttcaagtcgataacagcttccatgtcatttccatagaaagcaatccagcgaccggtcttatagttacgattacccgtcataccgtctaccagagtaatggcgccgttatattcatacgccttgttaatcggctgtaacatggtgattggttttgctgtcgacttacagaaagaaatgctgtcgcatgtaatgcgtgaagtaccttccggacgtatagcagccatacgcaacacacaagtcttgtcaatggacaaaccgttttcatacttcaacgaagcagttgtcggttccgtaccgtcgagtgtataatacacaggtgcatcgtcaatggtatacgcatttacatccagctttcctgtttcctgattaggctcaatcttcacatttacgtcgaaaatatgcgttgcatagttccatcccttcaactgataaatctttgtcaggcgggccgtacgcttcaggaagcctgcataatctttcttcttgtcgggagtactccactgcgtttcacaaagagcagccatacgcggtaacgtcatatactgtacctgagcgaaagtcggcatatattccgtccacacattagcctgtacacccgtaatgtatttttgttcttccggagtcaactcagccggcatcggctcatagctgtatacacggtccatcgggagatatcctccgatagccagcggctcgttttcggtatcttttgcctgataataatcgaagtacaaataggtattcggagtcatgatcacgttgtgtttctggcgtgcagcttcgatacctcctgcttcacctctccacgacataacggtagcattcggagccagtccgccttccagtatttcatcccagccaataatgttacgtccgtgctcattcaggaacttttctgcctctccgatgacatagctttgcaagtactcttctttcgaatgcttgctgtcactcttaatgcccagtgccttgattcttgcctgacatttcggacaagtcttccacttgtctttcgggcattcgtcaccgcctacatgaatatatttcgacgggaagatatcgataatttcactcagcacatccttgatgaactgaatcgtctggtcgtttcctgcacaaagcacattatcggaaacgccccacatcgtccagactttatacggaccaccggtacatcccaactccggataagcagccagcgcagcctgcatgtgtcccggaaggtcaatttcaggaataacggtaatataacgttctgccgcataagcaacgatttccttcgcttgttcctgtgtatagaaaccgccataaggcttaccgtcatattcacccgaattacgtccgattaccgtttcgtcacgtttcgaaccgatttccgtcagcttcggatatttcttgatttcaatacgccatccctggtcttcggaaagatgccagtggaaacggttgatgttatgcaaggcaagcatgtctatgtaggttttgatttcgtccacagtaaacatgtgacgacccacgtcgagcatcataccacgatagctgaaacgcggactgtcgttgatttccacggcaggcaattcaatcgctccacctccttcgtgtacagaaaccgacttacgcaacgtctgaatgccatagaatactccagcctcagaaggagcagcaatcaccactttcttgccatctacagtcatacggtatgcctccggcgaattagcttccagtcccagtttcagtacgattccgctttcttcatctccttcctgtaccttcaggtcaatgccggtctgctccttgatgaacgaagccagaaactcggcgttcttcttcatcttttcattaccggccgtgtaataaatcgtttctccgctcttcagcaggaagccgttttgttgaggagttgtcatctccaaaggcatcggcacaatctgataatcagcgacagccgtcggttgttccgtacaagaggtcgccaatataccggcaaatgccagccccaagcagttcaattttgagaagggtttcataaaagttaaatataaaggttagtattcaatttattcatgttcaatagagcagatatcacccaactgacgtatgttcaccgtgagatcttccagcgcacatccgtcgcccgaagttacaagtatctttcgggaaacaccaggcaacaggtcgaaaaaattatccgaaaaacgtactccctgaaccggtatctcgataaacacatcacgagccagctggtccgacttcaatgtcagttcataagcaccgtttttctttttcattttgcagctgatctttgcctgaggcaagtgctgagatttgggaagtgccggataataaacttcatccgaaagaatctctcggccatgccggtccttcaaggtcatgtggataaacgaagtagtcgtatcgcatgcggcaaaagcctgattccagtcctcttcgtaaaaaacgacggaagaattaaccggcagcttaccctctacctgatgccggcgcagcaccttccctttgaagttcatcagttccatctgcaacacgacatcttttgtcttcaacacatccgacataacatagtatctcagtttatctccctcacggatagcatctaccagcacgggggcaaatgcccggcgactctggtaatgcaaggccttccagttaccgaagtaatcgatagccgaccacgaaaccactggccagctgtcattgagctgccagattagactgcccatgcaatacggacgattccgacgatgcgcttccattccttgacgcattccgtgtccttgcagcaccaatcccagatacactaggccctcaaatttttcaggaaccggataatacagtcccatggtcttcttaatcaggaaattgccaattgaactcttctgatgcgcgttcatcaccggcgattccatgtcatagtcttccggcgtagcaaaggaatgtatggttttcatttcagggaacgactggaagccgaattcgctcatgaaacgggggatttccgtatccagactctcgaaaggtttctgtccgtaccatgttccccagttatggctgtcccctctcttccagctctccggcctgccccaattggcttcgtaaggagaactctccagataaaacctgccgggatccagctctttcactttttccggcaacagcttacggaacaatatatcatatccgtctgccagttgctgatagatttcaggaccgtatttccgcttccatccccaatatttcataccctcaccgacttcattgttgccacaccacattgccagcgaagcatgattgcgcagacgcttgatgttgtaaaccacttcctccgatacctgtttcagaaaagcagggtcatgcggataaggggtacaggcaaacataaagtcctgccacaccagtatcccccgcttgtctgcctcctcatacaaggcatcgtcttcatacactcctccgccccagacacgtatcatattcatgtttgcagcctgtacatcctccagcaggcggacataccgttcacgggtgacacgtggcaacaaggcatccgagggtatcagattggttcccttggcgaacatcggaataccgttcacctcaaaatagaagctcatgcccagactatcctcctcgtttacgacacgtatcgagcgaagtccaatccgatgttgctggctggcaaccgtttctccatccatgcagaccgaagcacggaaatcatacaaggcagcctctccccatccattgggcatccataaatgcggagattcaatggtcagaggaagcgataccgtattcagccccggttgcaagcggaccgtttgttccacgctccggctctcctcctgtccgtaagcataggtcacctttacctgtgcctcccgtatttcgttgccgagattacgtatttccagccggttgtctacttccgcccggtcagaagttaccgactgctggcagacaaaataatcttctatttccgcctgattggcaaattccagacaaaccggtcgccagataccacatgtcaccatccggattccccagtcccagccgtatgaataaggcgccttacgggtgaagatacttacccgttcggcccgatgttcattggcagccggataaataaagccgtttgtttcccactgaggcatggcttcccgaatcggcgaacggaagcggatgagcagcttgttctccccgctcctcaaaacatgtttcaccggtacccgatagccgacaaacatattgttggccttcagtatgcatactccgttcagcgaaacatcggcatacgtgtcaagtccgtcaaaaaccagaaaaatttcttgatgtgcaagttgctcttccgagagcatgaaagacgtccgatacaaccagtcttcatcttccacccattgtatctctttttcattcattccgtaaaaaggatcaggtagtttacccagagccatcaaatcctgatggacagtaccgggcacagtggcaggcaaccattcatcacttccatactttgaaaactgccagttggagtgaagtgtcagactatcggcaagtgcggtattacccaacgaaaaaagacttgtccataataccgccagaatgattttccacatatttttcacattacagatttaagaaccataccactagatttcgctcccctcactctcatctttcaagagcttcttcttccttatgaaaaaagccgagaaagagcttcaaaaaagcaggacaaaaggatttcaggcgaaatttcttcatgatacaaaataaagcaagtttttccgataaaacaaataaaatcaatcggaaaaacttgctttatttcatcaaacgccctagggcttgtttaaatctttcagcctatcgccgaaatttattttactttcagcttatcaaatccttcgccgtatactcccaccacattgctttgggaaacaaaagcatccggatcgatatcttttaccagacggaaaatatcaagcgactcacctttctttgccagcaccacaataaccttgatgtcttgcttgctataccagccctgtccatcgagcaacgttaccccacggtctatctgggtagaaataccttctgctatctgctcatatttccgtgaaaagatcaggaactggaccgactgacgggaactgttgatcacatagtcaatgacgaaactcatgataaacagcacacagaaaccgaataacacgcgcttccagtcgtgaaagatgaagtaacacgacgaaatgatcacgatatcacagtacatcatcatgcgtcccaaggtaacgtccttgtatttgttgataatccatgcgataatatccgttcctcccgtactaccgttgttgcagaatacgataccgattccgaagccaagcagtccggcaccgatgacacaggccatgaactcctgccccggtcccaaaagctgaggaagatttccgtcactgttcctgaacaatacctgaaaccaccacagcaggaaagtcagcataaagatggcatagatggtcttcacactgaatttcggtcccagaatcttcaaggcaaatcccaggaaaaccgcattgatcacaaagtaagaaatctgaatctctatcccggtagcataataaataatagcggcaataccacttactccaccggttgttatctggtaaggcaacagaaaagcaacccatcccagcgcataacataccagtccgaaagtaatggcaaggtagtctttcgactccctgcctatttttctctttagaatcgcttccatacgtgtgcgattaaagtacgatgtttacaatcttcttcggcacgatgatgactttcttcggtgtcttgccttcaatccatttctgcgactgttcatcgctcataacggctgcctgaatggtttcgttgtctgcatcggcagggaattccatcgtaaagcgagcttttccgttgaaagagattgtatatttcacactgtcttccttcaggtattcttcgttgaataccggccattgtgcgtcacaaaccgatgtcgtgttacccaatgcttcccacaattcttctgccagatgtggagcaaacggagcaatcagtactaccagatcactcatcacggccttgttacggcatttcagtgaagtcagttcgtttacacaaatcatgaaggcactgatagatgtattgtaagagaaggtctcaatatcgcctgtcaccttcttgatcagcttatgaatagacttcagttcttccttagtcggctctcctgctgccggcatgaaattgccctgacggtcgtagaacaagttccagagcttcttcaggaaacggtgaacaccgtcaataccgtttgtatcccacggcttagactgctctaccggtccgaggaacatttcgtacatacgcagcgtatcggcaccatatttctcgacaatcatgtccggattcactacgttgtacatcgatttactcatcttttcgactgcccagccgcagatgtacttgccatcttccagaataaactctgcgttattgtattcaggacgccagttcttgaaggcttctacatccagcacatcgttcgatacaatgttcacgtcgacatgcagcggagtcacgtcatactgatctttcaaacccagtgaaacaaaggtattggtatccttgatacggtaaacaaagttgcttcggccctgaatcataccctggttcaccagtttctggaacggctcttccttgatgcttacacccaggtcgaacaggaacttgttccagaaacgagaataaatcaagtgtccggtagcatgttccgtaccacccacgtacaagtcaacattctgccagtaacggtcagctttttcagaaaccaatgcctgatcgttgtgcggatccatgtaacgcaagtagtaagccgatgaaccggcaaatcccggcatggtattcagttccagcgggaaaacagttacgttatctatcttggtattctctaccacttcacctttggttacatcccatgcccatttagtagcatgtcccaatggaggttcaccggtttctgtaggcaggaatttatctacttcaggaagttccagcggcaacttgctttcgtctatcatgtaaggcatgccatccttgtagtaaaccgggaacggctcaccccagtaacgctgacgggagaaaatcgcgtcacgcagacggtagttcactttgacacgacccaaatgatgttcttttacatatttcttggtagcagcgatagcttccttaatagtcagtccgttcaggttcaaatcgcagtaaggagtaactcctgccttcggtgaattacatacgataccctcctttgcgtcgaaactttcttccgatacatcacaaccttctaccagcggaatgatcggcaggttgaagtgttttgcaaacgcgtagtcacgactgtcatgagccggaacggccatgatagcacctgtaccgtaaccagccagtacatagtcgctgatccataccggaacagcctctcctgtaaacggattgacagcgtacgaaccactaaacacgcctgttacacgacggtcggcgatacgttcacgttcggtacgtttcttggtacgatccagataagcttccacttctgctttctgaccttcggttgtcagcagcggaacaagctcactttcaggagccagcaccataaatgttaccccaaacatagtatcggcacgggttgtaaagatggtaaattccagatcgctgtcttttaccttgaaacgaacttccgtaccttccgaacggccgatccagttacgctgtgtttccttcaatgaatcggtccagtccaccgtttccagtccatcaagcagacgctgagcataagccgaaacacgcagacaccactggcgcatcttcttctgaaccaccggatatcctccacgttcggatacaccgtctaccacttcatcgtttgccagtacggtacccaattgcggacaccagttcaccattgtttcacccagataagcgatacggtagttcatcagcacttcctgctgttctttttcgttcttggctttccattcttcagccgtaaagctcagttcttcagtgcaagctacatccaagccttccgttcctttttcttcaaaatgcttgatcagttcgctgataggttcagcctttccgcatgcgttacaataatagctgttgaacatcttctggaaagcccactgagtccaatggtaatatcccggatcacaagtacgcacctcgcggtcccagtcgaacgagaaaccaatcttgtccaactgctgacggtagcggttgatgttgtttacggtagtgatagccggatgctggccggtctgaatggcatattgttcggcaggcagaccgtaagcatcgtatcccatcggattcaatacattatagccctgcaagcgtttgtaacgagcataaatatcgctggcaatatatccaagcggatgtcctacatgcagtcccgctccagacggataagggaacatgttcagtacatagaactttttcttcgattcatcttcaacaactttgtaggtcttgttatccacccacctctgctgccattttttctcgatttctctgaaattatattccatagtggcgttatatatttgatttttttacgatttccgcaatatcgtgcaaagatagtaagtcttcgggaataaacccgatttttccgccaacaaatatcaatcaatcggttatctcgcagcctattacctcttgcttcttgttaaatgtcactacaaatactattttctccgtcagagaatgcaaaaaatttcatgaaaacatcgtcctattttcaacgtagttcacatattataaacaggcggtgaataactattaaaagattagttaataatctatttatcaaaaagaaatcaaaagtatttaatcaaaaaaacaggagattattaacaggactttcaacaagtatatcaatatataaaacagatacttccactcttttcacatacttatgaaacaatttatccgatagtccgcccacacctatgaaaacctactggtataagcttccaagtttttgtacaaaaataaatttcttttgtacaaaaaataaaaaaatatgcagacaaatctatccatattcgaagaggtttcaagcaacctttgcagatacttaaattacataacgtctcaaaaagaaaattcccctctgtacttctatccatagaacatacagaggggaatctatatccactatctaccagcctttaacttgcaaaatccgcccagttagtcagtcgcatatctccctttttgaggaatacctgatgcatacccagcgcagccgacaagctgtggcaagtctgccctttggtagaaatcttcaggtaatcccacaacaactgcttgtagtccggatgcgcacaattttcgatgacagcctgtgcacgctccatcgggctcttccctctcaggtcagcaataccctgttcggtaataatcacattcaccgagtgctcgctgtgatccaggtgcgataccatcggcacgatggaactgatacatcctcctttggccgtcgacggacaagagaagatcgaaatataagcgctgcgcgtaaagtcgcccgaaccgccaataccgttcatcatcttcgtaccacagatatgcgtagagtttacatttccgtaaatatccgcttcgatagccgtgttcatcgaaatgacaccgatgcggcgaactacctccggacagttggatatttccgacggacggagtaccagcttgtggcggaagaaatccatattatcgtaaatatcttgcagacagtcgtttgtcacactgagcgaacaggtactaccaaacttgattctaccctcttttatcagattaatgaccgaattttgaatgacctccgtatacatttcaaacggcggaatgctggggtctttacccagcgcactgagcactgcattggcaatgtttcctacgcccgactgcaacggcaggaaggtagacggaataatcccgcggcgcatgtccgcagccaggaaatcggcaacgttctgaccgatcttatcggttacagggtccggatcgtggaaaccacgtgcttcatccggaagatttacctccaccactccgacaatctttgctggatctacctgaatataaggcaacccgatgcggtcgctcggacgtacgatcggaatcggacgacgatacggcggacgttccatttcgtacaagtcatgcactccgatcagtctcttgctgtgagcagcgttcagctctacaatcacgcggtcggccaggcgggcaatcgtcggcgagatacccactcctgccgtcagataaatccgtccgtcggcagtcagttcacaagcttcgataattgccgtagtcacgtgtcccagaaacccggaacgcagacgctgcgctacttgcgacaaatgtatatcagtataattaatctctccggcattcacagccttacggaaatcaacattcgttgtatatggtgcacgaaaatgaatagcatgagcacgagccagcaccccgtcgcaagaatctcccgtagaagctcccgtaatgattcctacctgaaactgttctccccgggcgtgtttctcttctgcctgcttggcaagctctgccgtaacggctttcggacttcctgccggtgtaaacccgctcagggcgattatctctccatcttttatcaggctggcagcttcggctgcggtcataatgttataattcatggtattaggtgtttttataattgttagtattaaactttcattactttcggtttctagtatttacggttaaaaatttcggaataaataaaggcacgccgcgcctcttccggtgttctcagccggatatccctgcccgacgtacttggcggagccgcatgctgtacatccctttcttgcggtttcccggatgttttccggttccttctctccgctccttctctccttctatttttctcttttacagcacgatgagctacatgctcttctttcacgaaagactcagcatcttccgcttccacacgcaccggtgctctccccgccgttctcccgcgggaagtacgatttcgtttcttttcttttttgatataattccgatacgcagtcagggcaacagccactaccacaaccagtatgcttaccacgtcgtccatcgtctgtccaaatgttaaggagttgcccaaagatactaataaatatcacatattcatggaatttagggaagaaactcatatatttgcaaatgaatttattaaataataacataacattatgacaaaagaagctacgggagcggactttaaatccgcaaccgaactggaaaccaaaaaactatttattgagacttacggttgtcagatgaatgtggccgacagcgaggttatcgcgtctatcatgcagatggcaggatatactccctgcgatagcctggacgaagccgatgccgtatttatgaacacctgttccatccgcgacaacgccgaacaaaaaattctgaaccgtctggagttcttccattcgctgaagaaaaagcgcaagcatctcatcgtaggtgtactgggatgtatggccgaacgtgtaaaaaacgacttgatcgaaaaccatcacgttgacctggtagcgggacctgattcttatcttacgctgcccgatctgatcagtgccgtcgaggcaggagagaaggccatcaacgtagaactttctactacagagacttaccgcgatgtcattccttcacgtatctgtggaaaccacatctccggctttgtatctatcatgcgcggatgcaacaatttctgccactactgcatcgtaccttatacacgcggacgtgaaagaagccgcgacgtggaaagtatcctgaacgaggtccgcgacttgcagcgcaaaggttacaaggaagtgaccttgctgggacagaacgtaaactcttaccgtttcgagcgggaaggagaggtggtaacattcccgatgctgctgcgcatcgtggccgaagccgtacccgatatgcgcgtacgcttcacgacttcgcatcctaaggacatgagcgacgaaaccttacatgtcattgccgacgtgcccaacgtatgcaagcacatccacctgccggtacagagcggaagttcacgtattctgaaactgatgaaccgcaaatatacacgcgaatggtacctggaaagggtagaggccatccgccgtatcatccccgactgcggactgagcacggatattttctccggcttccactccgaaacggaagaagaccaccagatgagcctctcgctgatgcgcgaatgtgcttacgactcggccttcatgttcaagtattccgagcgtccgggaacatacgcttccaagcatctacccgacgacgtccccgaagaagtcaagatacgccgcctgaatgagctgatcgaattgcagaatcaattgtctgccgagagcaatgcccgcgacgtaggcaaaaccttcgaggtactggttgagggagtatccaagcgctcaaaagaacagctgttcggacgtacagaacaaaataaagtcgtggtattcgaccgtggcacgcaccgtatcggcgatttcgtacgtgtacgcatcaccgaatccagctctgctacgctgaaaggcgttgaagttagtgactaatcccaaaaacaataacgaaatacataaaatcaaattcgaaaagtaacaatgaaaagaagaatcacgctcagttggctgctcatggcactaatctgcttgcccatgttcgctcagatgcaagatccggtacggttcaagaccgaatggaaaactctttcggctaatgaagctgaaattatctttactggtacgatggaccagggttggcatgtatattctaccgacctgcaagaaggaggtcctacttctgcaactttcaacatcgataaaatagaaggtgccgaactggttggtaaattgactcctatagggaaggaaatcaaacagatggatcctatttttgaaatggaagtgaaattcttcgaaagtacggccaaattctctcagaaagttaaactgaccggcggcaattacctgattaccggttacctggaatatggcgcttgcaacgatcagaactgtctgccacctaccagcgtagatttttcttataaaggaacagttgccgcaactgcttctgctacaccggctcctgctaagggtgaagaagaagttgccgccagcgaacctgccgaaacagcagattctacggcagtagcaacagctcctcagacattgaaggaagcaaccgattactggaaaccggttatcaaggaactttccagctacggagacaacgaagaacagcagtcacattcctggatttatatcttcttcgccggaatggtaggaggtatacttgctttgttcactccttgtgtatggcccatcatcccgatgacggtcagcttcttcctgaaacgtaccaaggacaagaagaaaggcattcgcgacgcatggacctacggagcttctatcgtagtcatctacgtggcattaggacttgccattacgttgattttcggagccagtgcattgaacgctttgtcaaccaatgcaatcttcaacatcttcttcttcctgatgctggttgtcttcgccgcttctttcttcggagcgttcgaaatcaccctgccgtctaagtggagcaacgctgtcgacagcaaggcagaagcaaccaccggtctgctcagcatcttcctcatggcatttaccttgtcactggtatctttctcttgtacaggtcctatcatcggattcctgctggtagaagtttccaccacaggtagcgtggttgcaccggctatcggaatgttgggcttcgccattgccttggctctgccgttcaccctcttcgccatgttcccgtcatggttgaaatccatgccgaaatcgggtggttggatgaacgtcatcaaggttgtactgggcttcctggaactggcattcgcactgaagttcctgtcggttgccgacttggcttacggctggagattgctcgaccgtgaaaccttcctggcactctggatcgttatctttgcactgctgggtatgtacctgctgggcaaaatcaagttcccgcacgacgacgataataataaggtaggtgtaggacgcttcttcctggcactcttctcactggcctttgccgtatacatgattccgggactttggggagcaccgctgaaagctgtcagcgctttcgcacctcctatgcagactcaggacttcaacctatacaagaacgaagtacacgctaaattcaacgacttcgatgccggtatggaatatgcccgccagaacaacaagccggtcatgattgacttcaccggatacggctgcgtaaactgccgtaagatggagcttgccgtatggaccgatccgaaagtcagccagattctgaacgacgactacgtactgattacactgtatgtagacgagaagactaagttgccggaaccgatcaaggtgacagaaaacggaacagaacgcactctgcgtacgataggcgacaagtggagctacctgcaacgttctaaattcggagccaacgcacagccgttctacgtattgcttgacaacgaaggtatgccgctgaaccaatcatattcttacgacgaagacattgccaaatacgtagatttcttacagacaggtctgaagaactacaagaaataattcccaatgggagacaacatgaagaagcttccggaaatcttttagtggtttccggaagcttttttattttttacaaatcaatatgatcccatgatttatttcttatactcttaaagaaccttaacgaaacgccctccatacccgatttatttgttattttgcagcaaattagggaataaagtgaatatactcaatatagatacatgtcccctctgcggaaaaaagcatttcgaagaggtgctgacttgcacagatcattatgcgaccggtgaaaaatttaccatttaccgctgtacggcgtgtggctttctgtttacacagcatgtgcccgacgagagtgtgattggccggtattatgagtctccggactatatctcgcatacggatacgcgtaaggggctggcaaaccgcctgtaccattatgtgcgcggatatatgctgggacggaaggcggcactgattgagcggatctgtggcatgcgcaacggctacctgctcgacattggcacgggtacggggtatttcagccggtatatgcagaaacgtggatggaaggtttcggccattgagaagagtccgcaggcccgggcgttcgcacgggagcatttcggactagaggtggccgctccggaaaagctggcttcgtacggaaaggacacattcgacgtggtgacgttgtggcacgtgatggagcatttgcaggatatcaacggtacgtggcagcggctttccgaaatcttgagggataagggaatattggtcatcgcagtgccgaacccagcttcattcgacgcggagcattacaaggaagtatgggcggcgtatgatgtacctcgccatttgtggcatttcacaccgtcggccatgcagcagttcggagcgaaatttggatttattctgacggaacggcatccgatgccgtttgacgcattttatgtttcgatgctttcggaaaagtaccggggaagccatatgtctttcctgaaagggatgctcacgggaacagaggcgtggtttgcctcgctggtaaagaaggaacgaagtagttccatgatttatgttttcagaaaaaaataaggctatgggcagaaaatcgggatctttctttgatatgcagttcgttacatcgagcatcagtacgatgctggtgttgctcctgctgggaatagtggtattcttcgtgatggctgctaacaacctgtcggtatatgtgcgcgagaatatcgcgttctcggtgttagtaagcgacgacatgaaggaaccggatattctgaatttccaaaaacaactaaacaaggagccttatgtgaagcagactacatatatctcgaaggctcaggcgctgaaggagcagacagaggcaatgggtacggacccagcagagtttatcggacataacccgtttacagcgtctatcgaaattaaactgaatgcggattatgctaattcagacagtatctcgtggataaaggatgaaattcagtcgaacaagcaggtgattgaaatcagttatccgcaggatctgctggatgcagtgaatagtaacattcggaaaatcagcatcgttctgctgggattggcggcgttgctaacattgatttcgtttgcgcttatcaataataccatccggctggcggtgtactccaaacgattcatcattcataccatgaagctggcaggagcgagctggtcgttcatccggcggccgttcctattacgcaacgtatggatcggggtgctggcggctaccatggcagatgccatactggtgggactggcttacatgctggtaaagtatgagccggacttgctggcggtggtgacgccggaggtgatcgtgacggtgatgggttcagtatttgtgtttggggtaattattacttcggcatgtgcgctcatttccatcaacaagtatctccggatgagggtgagcgagctgtattatatatagtaaggtaagaaactaactaataatcaatatttcatagtaacatggataaaaagaactttgcctttgataagacgaacttcatcctgctggctgcgggaatggtggtgattatcatcggcttcctgctgatgacgggacccggctcgacggaaacgactttcgagcctgatattttcagtgtgcggcgtatcaaggtggctccggtggtttgcttcctgggattcatctttatgatttatggtatactgcggaaaccgaagagcacgcaggaaaaggataataacgtaacggaatgagctggatagaagcattggtgctgggtattctgcagggactgacggagtacttgccggtgagcagcagcggacatctggctatcggatcggcgctgttcggcattgagggagaggagaatctgacgtttaccatcgtggtgcatgtggctacggtgctgagtacgctggtaatcttgtggaaggagattgactggatatttcgcggactgtttaaatggcagttgaacgaggaaacgaaatatgtattgaacatcattgtttcgatgattccaatcggcatcgtgggggtgttcttcaaggattatgtggaggatatcttcggatcgggactgctgattgtgggctgcatgcttttgctgacggcggtgctgctggcgttttcgtattatgcgaagccgcggcagaaggagcgtatcagcatgaaggatgcgtttatcatcggagtggcgcaggcgtgtgcggtgatgccgggactttcgcgctcgggtagtacgattgctacgggactgattctgggaaacaagaaggaaacgctggcgcagttctcgtttctgatggtgattccgcctatcctgggagaagcgctgctggacgggatgaaaatcatgaaggatgcttcggctgcgggtgccaatgtgagcacggcatcgctggtcgtagggttcctagcggctttcatctcgggatgtatcgcttgtaagtggatgattaattttgtaaagaagggcaagctgatctggtttggtgtatactgtgccatcgccggaatcattacgattgttgccagcttgtgtgcataaacagatacggatgaactttaaagagggagaagtgttatactttgacaagccgctgcgatggacttcgttcgcgcttgtcaacaaggtgagatatcatatcagccgcaaactgggagtgaagaagattaaggtgggacacgcgggaacactcgacccgctggctaccggggtgatgattatttgtacgggaaaggcgacgaagcgtatcgaggagttccagtatcatacgaaggagtatatcgctacgctgaagctgggggctaccacgccgtcgtacgacctggagaaggagattgacgcgacgtatccgacggagcatatcacccgccaactggtggaggagacgctgaagaggttcgtgggaacgattgagcagattccgccggctttctcggcctgcaaggtggacgggaaacgggcgtacgacctggcccgcaagggaaacgaggtggaactgaagccgaaaacgctggtgattgacgagattgaactgctggaatgtgacttgccggtgataaagatccgggtggtgtgcagcaagggtacgtatatccgtgcgctggcacgcgacatcggggaggcgctgaacagtggggcgcacctgatcgggctgatgagaacccgggtgggcgacgtgaagctggaggactgtatgcaggtggatgacttcgaggcgtggctcgaccaacaagatattgaaattacaaacgattaaggaaaggattataagatgaaactgtcacaatttaaatttaaattgccggaagagaaaattgcgctgcatcctgcaaagtatcgggatgaatcgcgactgatggtggttcacaaggctaccggacagatagaacatgtgatattcaaggatatcttgaactactttgatgacaaggacgtatttatctttaatgatactaaggtttttcctgcacgtttatatggtaataaagaaaagaccggagcacgcatcgaggtgttcctgctgcgtgagctgaacgaggagctgcgcctgtgggatgtattggtggatccggctcgtaagattcgtatcggtaacaagctgtacttcggggatgatgactcgatggtggcggaagtgattgataatacgacttcacgcggacgtacgcttcgtttcttgtacgacggaccgcacgatgaattcaagaaggcgctgtatgcgctgggtgaaccaccgttgcctccgtttatccatcgtccggctgaaccggaggatacggaacgcttccagacaatctttgccaagaacgagggagcggtaacggttccggctgcgggactgcacttcagccgtgagctgatgaagcgtatggagattaagggtatcgagttctcgtttatcaccatgcactgtggactgggtggattccgggatattgatgtagaggacttgacgaaacataaaatggactcggaacagatgttcgtggaagcggaggcttgccgtatcgtgaacgacgcgaaggatcgaggcaacaaggtgtgtgccgtgggtacgagcgtgatgcgtgccatcgaaacggcagtgggcaccgacggacgactgaaggagttcgaaggatggaccaacaagtttatcttcccgccttatgagttctcgctggcggatgcaatggtcagcaacttccacatgccgctgtctaccatgctgatgctggtttgctcgtacggtggctatgagctgattatggatgcgtacaacattgccctgaaggaaggataccgcttcggtacctacggggatgcgatgttgattctggataaataagcgtaccgtcatggcgaaggtttatttgggcctgggtacgaacatgggcgacaaggaaatgaatttacgtactgccgttcaatggataaatgacaggataggggaggtgacttccctatcttctttttatgaaacggctccgtgggggtttgtttcggacaacagtttcctgaatggggcggtgtgcgtggaaacagagctgatgccgctggaggtgctgcaccgcacgcaggctatcgaaagggagctgggacggacgcacaagtcggtgaacggggtgtacagcgaccgtatcatcgatatcgacctgctgctgtacgaagacgtggtgatgcagtcgccggaactgacgctgccgcatccgctgatgacggaacggggctttgtactggaaccgctggccgaaatagcgggggaagtggtacatccagtacgcaaacagaccatcggggaattatattctttttataaagctatgttaaaagaagaataacttgtaattattccaatttatatctgtatttttgcaggcgaaaataaaagtggaaagatttgagtagcttgcaaccacggaaaaaaatgctaaaacacatagtaaacccttccctgaaacaatttctactctgtccgtacacggataatattttactaatccttttttaatttcaaagacatgggatacttattcacatccgaatcggtgtcggaaggacaccccgacaaagtggcggatcagatttccgacgctgtgcttgacaaactgttggcttatgaccccagttcaaaagtagcttgcgaaacgctggtaacaaccggacaggtggtactggcaggagaagtgaaaacgaaagcgtatatcgacctccagcgtgtggcacgtgaggtgatcaacaagattggttataccaaaagcgaatatatgttcgagggtaattcgtgtggcgtgttctcggcgattcacgaacagagccctgacatcaaccgtggcgtggaacgtgaggacccgatgaatcagggtgccggcgaccagggtatgatgttcggctacgcaacgaacgaaacggaaaactatatgccgctgtcgctcgacctggcgcacaagttgctgatggtgctggctgaaatccgccgcgaaggtaaggtgatgacttatctgcgtccggactcgaagagccaggtaacgatagaatatgatgacgaccgtcgtccggtacgtatcgatacgattgtggtttctacacagcacgatgagtttatccagccggctgataactcgaaggaggcgcagctgaaggcggacgaggagatgctggccaagatccgcaaggacgtgatcgaaatcttgatgcctcgtgtgatctcggaaattcataatccggacgttctgaagttgttcaacgaccagatcaaatatcatgtgaacccgacgggtaagttcgtaatcggcggaccgcacggagatacgggtctgacgggacgtaagattatcgtggatacatacggtggtgccggtgctcacggtggtggcgcgttctcgggcaaggatcctagcaaggtggaccgtagcgcagcatatgcggctcgtcacattgccaagaacctggtggctgccggggtagctgatgaggtactggttcaggtttcgtatgcaatcggtgtggctcgcccgattaatatttatgtcaatacatacggacgcagcaaggtggctatgagcgacggggaaatcgccaagaaggtggacgagattttcgatatgcgcccgcgtgccatcgaggaacgcctgaaactgcgtaacccgatttacagcgaaacggctgcttacggacacatgggacgtgaaccgaaggtggtaaccaaacactttgaatcggcatacgaaggcaacaaggatgtagaggtagaactcttcacctgggaaaagctggactatgtggacaaggtgaaagaggctttcggattgaaataacgaatgatttaacggaaataacagaagatggggaatattccagcaggtgtattcctcatttttttgtctttactttcagatggaacaatgaacgatatcaagaatgtatgtgtatacagtgcctcgagcactaagatagaccagtcttactttgatgcggccaacagactgggggaggttcttgccgaacggggtattaacctgatcaacggggcgggatgcctgggactgatgcgtgcggtcagcgatgcggctctgcgggcgggaggcacggtgacgggggtaattcctcattttatggtggaacagggatggcatcacaagggactgacccggctgattgaaacggaaaccatgcacgaacggaaacagctcatggcgaatatgtcggacggaatcatcgctctgccggggggatgcggcacgctggaggagttactggagattattacctggaagcagctgggactgtatctgaagccgatcgtgattctgaacatcaacgatttctatcgcccgctactggagatgctggagcaagctatcgaacagaatttcatgcgtcgggagcatggggcgatctggcacgtggcccggactcccgaagaggccgtaaatttattgtatgatacgcccgtatggagcaaagaaattcgtaaatttgccgcaatatgagcaacgtttgccgaatagggataaaatatatggctgaaaagatggacgagcagcaacagcagctcgaccatgccttggttatgagcatacaggcggatcacaaggccggtatgcaaggccagccattaccctatcagctgcggtcggatgcggtcgtgacaagcatcgtcctggtttgctttattttgttctcgtatgcgctgaagcatggtaagaagtatgtggtgcagcggatcaagtcgctcttccagtataaggaacggacgagcttgtttgatgaggcttctgcctcgagcaaccgctatacctttacccttacgctgatcacgactacgctggcgggactgtatatctacgaatatatctccgaaacaaatccgatactgataaaatcggtcaccaacgaactgctgctaggaatttatatcggggcggctctgctctatatcactttcaaaggggtggtgtatgagttcgtgaattggattttttttgacaaagaaaggaacaaatactggattcagacgtattttgacctggtaagcggggccagttttctgctgtttccggtggttttactcattatttattttaatcttgggattcaaaccagtaagacattaatcatatttctactggtttttgctaaaatattgttattttacaagtctatcagaaactttttcaaacatgtttatggttttctgcattttattctgtacttttgtgcactcgaaatcatccccttaatactattttggaaagggataacctatataaacaatattttggtattaaaattttaagacattgaagattaaaaaagttctcgtttctcagcctaaacccacatcagagaagtcgccttatttcgacattgctgagaagtacggcgtgaaaatagatttccgcccgtttataaaagttgagagtctgtcggcaaaggaatttagacaacagaaagtttctattttggatcataccgccgttgtatttacttcgcgccatgcaattgaccacttctttagtctttgcgcagagatgcgaattactataccggaaaccatgaaatatttctgtacgtcggaaaccatcgctctctacatccagaaatatgtgcaataccgcaagcgtaaggtattcttcggtgcaacgggtaagtttgccgatctgctcccgctgatcgtaaagcacaatacggaaaagtatttcattccgatgtcggatgtacataacgatgaaatcaaaaacctgctcgacaagaacaagattcagcatacagaagcaatcatgtatcgtacggtaagcaatgatttcactccggaagagaaattcgattatgacatgctgattttcttcagcccggcgggtattcagtcgctgatgaagaatttccctaactttgaacagaaagacatcgctatcggtagtttcggaccgactacagctcaggctgtaaaggatgcaggattgcgcctggacctggaagcaccgacagcagcagctccttcgatgacagctgcactggatatgtttatccgtaagcataacgcataaatcaattcatattcaggcacggactacacgaatgcacggatattcttttcgcgtatcggaagtaatccgtgcctcaattattttatcatggcagaacaagaaaagcatacattccataagacagaacgactgaacagtgtaatcctcattgaaaagttgtttgcgggcgggagcaagtcgcttccggcttttcctctgcgtattgtatatatgcctgtggagggggacgaactccctgtgctctcggtactgatcagcgtgccgaagaaacggtttaaacgggctgtgaaacgaaaccgtgtgaagcgccaaatacgggaggcttaccgcaaaaacaaggcgctactgacggaaccgctgaaagctgccaaccgaaaggcggctgtggctttcatctggctggataatgaactgcatgactcggctgaggtggaagagaaagtgaagaaattgcttcagattacagcggaacgcatgctatgaaaaggctgctgacatatatcttgctgattcccatctatttttaccggaattgtatctctccttttacgccaccttcatgccgctttacgccgacgtgctcgcagtatgccatagaggctatcaaaaagcacgggccgctcaagggattgtatcttgccatacggcgactgctgcggtgtcatccgtggggtggctcgggatatgatccggttccctgatatattatactgaccgatatgttgctcgatgttcatacgcaccgcttgcccgacgatgcttcgacggtgctgctgagttgttcgctgaggaatgtgccgctcccgaaggaggcgcggtttctttccgtggggattcatccgtggtatatcacacgggaggattacggctcgcaggtggaatgggtggaacggatgctggacgacaggcgggtaatcgcgctgggggaagcgggcctggacaagcggtgtgctacgccgttcgacttgcagctggaggcgttccggtatgtggcgcagctggccgacgaacgtgaactgccgctgctgattcatgcggtaaaggctacggaggagctttttgcaatcaagaaggaaatgcgcccacgcaatgcgtggattattcatgggttccggggaaagaaggagctggcggagagtctgctcggacagggattctatctgtcgttcggcgagaaataccagcccgaggcgttacggataactcctgaagaccggctgctgctggaaaccgacgaggctacggcagacatcgcggacgtgtacgaaagggtggcacgggagcgaaaaagggggctggaagagttcacggcaaaggtgcaggaaacaattaaccggctcttttttaatcaataaaattggttattcagataaagtgtcgtacttttgctgtcaatcaaattattatgttaaactaagaatttcattcgatgaattttgtagaagaattaagatggcgcggaatggtgcacaccatgatgccgggcacagaagaattgctggaaaaggaaatggttacagcgtatctgggtatcgacccgacagctgactctttgcatatcggacatttgtgtggtgtgatgatgttgcggcatttccagcgctgcggacacaaaccgcttgccctggtaggaggtgcaacaggcatgatcggcgacccgtcaggtaagtcacaggaacgtaacctgctggacgaagaaacattgcgccataatcaggaatgtatcaagaagcagttgggcaaattcctcgactttgagtcggatgccccgaaccgcgcagaactggtgaacaactacgactggatgaaagacttctcgttccttgactttgctcgtacggtgggcaagcatatcaccgtaaactatatgatggcgaaggaatcggttcagaaacgattgaacggagaagcacgcgacggtctttcatttacggaatttacgtatcagttgctgcaaggatatgacttcctgcatctgtatgaaacaaagaactgcaagctccagttaggtggctccgaccagtggggaaacattacaaccggtgccgaactgattcgccgtaccaacggcggggaggtgttcgcgctgacatgcccgctgattacaaaagccgacggaggtaagttcggtaagacagaatcgggaaatatctggctcgatccgcgatatacttctccttataagttctatcagttctggctgaacgtgagcgacgatgatgccaaacgttatatcaagatcttcacttcgctgccgaaggaggaaatagaagcgctgacagcggaacatgaacaggctccgcacttgcgtgtattgcagaagcgtctggcaaaagaggtgacaatcatggttcactcggaagcggactatcaggctgccgtagaggcttcgggtatcttgttcggcaatgctacttcggatgcgttgaagagactggacgaggatacactgttgtcggtattcgaaggtgtaccgcagtttgaagttgccaagacggaaatagaagcgggtatcaaggctgtggatctgtttacggaaaaggctgccgtatttgcttcgaaaggtgaaatgcgtaagctggttcagggtggtggcgtttcactcaacaaggaaaagttgactgccttcgatcaggtaatcacggctgccgatctgctggacgaaaagtatctgctggttcagcgcggcaaaaagaattattatctgctgatagctaaataatgagataaataaacagataaagtatattacgtaatcccttgccccttgcgggtgagggattttttttgtcgctgaaagtcacgcggaaacatcttaacagaaaagtaatttcgtatacatctctatgtaacagcaagcatctacttttaggtagtttttaaaaagggatgtattatggatattatcgcagggaaatatgctatcggatgtacaccggaaggcaactattatgcttatctgctgacgcacgaacagtgttgtgcgtatggagaaagtgaagaggaagctctggagaacctggaggtgatggaagaggaatatctggaggaaataaacgaattgtatcaagaggctatggcttaaaaatcttctatatgaaaaacttattatcggacgaccggatgaaggcgtatgctgtctgcctggtcatgtttctcttttcttcactgtatctcttctatctgggatacaaactttatcaatacggacattaaaacgaggtcatcatggaatcaagacgctattttcgtaccatcgtactttctgacattcatctgggtacttcgcattcgaaggtggaacaggtatgcaactttctcagtacaaccgactgtgaccggctgattttgaacggggatatcatagacggatggagcttgcagaaattcggctccggaaaatggaagcctcagcacactcgcttcttcaaaatcattatgaagatgatggagaactgcggcacagaggtgatttatataaggggaaatcacgatgattttatcgataacctggctccgctgaagtttgcgacactgagtatcgtgaaggagtatatgctggaaagcaacggcaagcattatttcgtaacgcacggggatgtgttcgacaaggtgactacgcagatgaaatggctcgccaaactgggggatatcggttatacgctgctgctctggctgaacagtcagtacaaccgctggcgcatcaagcagggcaagccttactattcgctttctcaggagatcaagcagaaagtgaaatcggctgtttcgtatatctccgacttcgaaaaggtgctggctgagttcgcccgcaaacggcagtgcgacggagtgatatgcggacatatccatcatccggagaacaagatgatagggggaatccattacttgaactctggtgactgggtggaaacgctctcggcactgacggaggatgagaacggaaactggaacattctgtattatactcctgatatggcggacgaaaacggagaaatggaagataacaatagggtattaacacttattcctgctgcatcatgaaagttttatttattgtgcaaggagagggcagaggtcatctgactcaggctatcgccatggaaaggttgctgaccagacacgggtatcacgtaacggaggtactggtgggaaagagtttgtcgaaacggttgccggggttctttacccgtaacatacaggctcccatcaaacagttctccagtccgaattttctgccgacacgctcgaacaaacgtgccaacattccctacagtctgctgtataacttgctgaagctgccggaatatgccgaaagcatgcgttttatccgacagcgtatcaaggaaagtcaggcggatatcgtcatcaacttttatgagctgctgacggggcttacgtatttcttcttccgtccggctgtgccgctggtgtgcatcggacatcaatacctgttcctgcataacgatttccaattgcccgcatccatcaacaagggggaattgtttctgctgaatctgttcagccggatgacttcgctgggggcatcgaaacgcctggctctgtcgttccgctcgatgaacccggacaagaagcaaaagatatttgccgttccaccgttgctgcgacaggatattttctatcaggaggtttctcagcataactatatccacggctacatggtcaactcgggatttgcagaaaatgtatacgaatggcatcagaagtgtccggatgtaccgctccgcttcttctgggaccgatgggacgaggagcctgtaaagcggatagatgacacgctgtcgttctatcagctggacgatacgctcttcctgcggcagatggcgggatgcaaggcgtatgccagtacggccggatttgaatcgatctgcgaggcgatgtatttcagaaagcctatcctgatggtaccggctcacatcgagcaggaatgcaatgcctacgatgccatgcagaacggagcgggaatagtggacgagaacttcaatctggaacggctgctggattttacaaaaacatatcagccgaacgctaaatttacctactgggtgcaatcggccgaaagtatcattctgaatgaactggaaagcctcgttccaacccattttgaagaacaaatgtacatggtagaagaatttatataaaaagacaaaaaaatctttctttttgtcatacacttgtaacatttatgtatttcctttacaaaaaatatgtttttgtatggcacagaagaaaaaagaacttccttatttggaaagagatatcagttggatgtactttaaccgccgtattttgcaggaagcggcgcgtccgcatgtacccttactggagcggatgtcattcctgggaatttactcgaacaacctggatgagtttttccgggtccgcatagctacacagaaccgtatcgccgaatgctcggataaatcgacagctaaagaaagcgatcatgccaaaaaactgatcaagcaaatcagcaagctgaacacggaatataccaaggtattcgagcagactatccaccagactaccgaggacttgaagaaagaaaatatcttcctcatttcggataacgaggtttctcccgaacagctggagtttatccgttcgtattatcaggagaagctgagcggttcgattattcctatctggttttctgccatccggtatttcgacttcgagaacgatgagaacatttacctggctgtaaaggtcagccgacagcagggaagcaaacagattgccgactatgcgtttctggaattgccggtcaacatctgcggacgctttatccgcctgccggacaacgaagaaaagagttacctgatttacctggatgatgtgatccgctgctgcctgccactggtgttcgagggactgggcttcacggattttcaggcgtatgccttcaagtttacccgcgacgcggaaatggaaatagacaatgacttgcgtacgggtactttgcagaaaatctcgaagggtgtgaagagccgtcgccgtggagaaccgctgcgtgtgatttatgactcgtgcatgccgaaagatatgctgagacgggtactgaagaagatggatctggatgccctggatacggtgatagccagcggacgctaccagaaccacaaggatttcatgaaattccccgattgcggacgaagcaacctgaagtatccgcaatggccgtcgattctgaagaaagaactggacggcgaagacagcctgctggcaaagattcagaagaaagaccggtttatccatgtacctttccataactttgattcgtttatcagggtacttcaagaagctgctgtaaacaagcaggtacagagcatcaagattacgctgtaccgactggcgaaggaatcgaaggtggtcaaggcactgatggcggccgcacgcaacgggaaaaaggttacggtggtcattgagctgctggcccggtttgatgaggcttcgaacatcaactggtcgaagaagatgcaggatgcgggagtaaacgtaatctttggcgtggaaggcttgaaggtacattctaaaattacgcacatcaagatgaaaaagggaccggatattgcctgcatcagtacgggtaacttccacgaagggaatgcacgtatgtataccgactgtatgctgatgacggcggctccgcgtatcgtgaaggatgtacatcaggtattcgactttatcgagcgtccgtacagtccggtgaaattcaaggaactgcttgtttcgccgaacgagatgagaaacaagttcgtcaacctgatcaataatgaaatcaagaacaagaaggccggaaaagatgcctacatcaagataaagatcaatcatatcaccgacccgctgatggtgaacaagctgtatgaggcttcgcaggcaggggtagacatccaactggtggtacgaggcaactgttccctcattaccggcatagagggcgtaagcgaccatatccacatcaacggtatcatcgaccgttatctggagcattcacgtatctttatctttgctgcgggaggcgaagagaaggtgttcatcggctcggccgactggatgccgcgcaacctgaacaaccgtatagaagtcattactccggtatacgacccggccatcaaggaagaaatgaaactgattgtggaatatgggttcaaggataccctgcagggacgtatcgtagacggaagcggccagaacctcttcaaggaaacagaaggagagaagcctttccgctcgcaggaagcattatactatcactacatagaagaaaatatataatatgaacgaaagcgaaactcgaaaaacaaactatgctgccatcgacatcggatcgaatgcagtacgtttactgataaaggaaattgaggagaagcaaggcgaaactcatttctctaaggtactgatgctacgtgtcccgctccggctgggattcgacgtgttcaacatcggaaaaatttcggaaaagaaagaaaagaacatgattcgtctgatgaagtctttccgttatctgatgaaaatctatgatgtgaaacattgccgtgcctgtgcgacatcggcgatgcgcgacgctaagaatggcctggaaatcatcaagcaaatcgaaaagaaaacagatgtgcacatcgatatcatcgacggacaggaggaggccaagattatctacaacaatcacgtggagcacatggaagaccagaagggtaactacatgtatgtcgacgtgggaggtggcagcacggaaatcaacttgttgtcgcaagggcaactggtgtgcagccgttcgtacaacatcggtacggtgcgtatcttgaacaatgcggtaaaggacagtgaatgggaacgcctgaaaacggatctggctgagctggccaaatcgtatccgggaacgaatatcatcggttcgggaggtaacatcaacaagctgtaccgccttgtggaaaagaagaacaaaaagaaaatgacaatgctcgtttctacgttgcaggaactgcatacccgactgaaagcgctctcggtagaagaacgtatggaacagttcggcctgaagcctgaccgtgccgacgtaattgttccggcaggtgatatcttcctcaccatcgccgaaattatcggagctacgtacattcatgtaccggttatcggtttgtccgacggtatcatcgacgagctgtatatgcagaataaaaacaactgatgccgcaaggcattccatcataaaaaaatgtggcactgaatttcgtttcggtgccacattcttttttggttgaacaattgatttatttattgtcaatctctttcagcaattcatcgacagctgccttcaactgcgtatcttcacctttcacaatggtttcaggagcattcagcacgtagatatcaggatcgagctgagtattctccaggtaactgccgtcgggcaaacgataacccactacaggaataccgaataccagtgtcgggtcttgcattcttacccagttcacactggtcatggttcccggtacaggagcacctaccagcttgcccaggttacaatgcttgtatacccacggcgtaccgtgtgcattcgagtagttcgcttcacactgcaacatgatggaaggcttgttccagcgacggcttggcatatcgcatgcttcacgtccgcgaatcacctgtgtaaagtatttctttccgctgaacaatacttctatatcttcgtgcagacggccacctccgttgaaacgggtatcgatgacgataccttcgcagttattgtatttacccaagatatcggaatagatggtacggaagctttcgtcgtccatcgcttcgatatgcacatatcccagacggccgttcgaccatttcgctacatcggcagcacgctgttttacccagcgctggtacaacaaataactaaacgttcctccgctgaccggacgtaccacttcgtcccagtgttccttggtctgcggatcgtacagcgataccagtactttcttgcctgtcttgccgttcagcagcgcagcataatcttcatcagccttgatcgcttcgccgtcgatcttttcaataatagttccgactttgacacgggtagtcttacggtcgaacggacctttctctaccacctcggcaatacgcaagccgtcgcccgtataatcccagtcgtacaatacgcccagctcggcagtcgactctgttttcagatccggatagaaacgtccgccggtatgagaaacattcagttcacccagcagttcactcagcatctcggcataatcgtagttattgttgatatgcggcaggaacttccggtaagtagcagtcatggcatcccagtctactccgtgcatcttttcattatagaaacgagccttttcctcacggtacatattatcgaacatgtattcacgttcttcggaaggcaacagtttcatgctggcagtataagtgatcggcttcaggctttccgacgaagcatccattttctgcatggtacctccgcccagaataaagaagttcttaccctctttatccatttccatattcgcccattttgcatccatcttatgcaacagcttggtgtcgtgtttgcggagatccatcttccacaaatcgtatccaccttcgaaagccgacaggtaatacagtttctcaccgtctttcgagataatggccgaagctaagtcagaagaattcggagtcagacggatgatacggtcttcgattccttccgtttctaccacaatatccttcaccttcttttcgtccttggcatccttatcgtccgattttttgtctttcttggaagccttatcatctttcttagcagctttttcctgctccttttccagttccttctgcaattcgtaatcctccttgctcaggcggaacttatcgtatgcatcctgattgaggaaagcaatcatcacatcgttcagcgaaccccatgaagcatgattacgcataccgtaacgctcggtaatgaacaagatggcatttccatccatcacccagcgcggagagtcactgatataaccactgttcgtcaggttaataatctgtccctttccgtcggcactgaccaaacctatatccgaatacggatcgtgcttgttgccgataaacacaagcgtaaaccacttgccgtcgggcgaccaggagtaatcaaatcctcccgagcgcgtataccaggtagaaccatccgttacctgacgaatctgcttggtagccagattgaccaccatcagacggttgcggtcttcgatgaaagccacttcctttccatcgggagaaaactgcggataatcacgttccaacgttttagaaggtaccaatggttcctcttctatcagagtagcattcgggaagttcaggtcttccttccggctgattttggcaatatacaaatcgcgcttgccccctctctcactagaataaaccagagaacggttgtcggcaccaaatgaaatgccccgttctgcttcaggagtatgtgtaatctgtttggttgttccatactctacagaagtcacgaacacttctccacgtacgataaaggcaacctgcttgccatcgggagaaacgacagcctccgaagctcctcgtgtaaaggtataggaaacagggagttcctcatcatcgcgtaccagcgagatagctactttctgtggcttaccaccaaccgactgcgtataaatctcgccatcgtaggtataacagagcgtaccgtcggctcccatcgaaaggaatctgaccggattcgtcttgaatgacgtaaccggctgtacattcttcggatcatcgatcggaaaagaatagacattgaatgagccaccgttgcgttcgctcaggaagtaaacctgcttgccgtcggggcttacgatcgggttacggtcttcgcccggtctggccgtcagattggtatgttttcccgtctttacatcgtatctccatacatcgcgggtaatggacgaagtgtgatgcttacgccactcgttttccacccctttctgatcctgatacaggaagaaatcacccgacggagcatagctgatcatctcagccggcgttcctaacatctgctgtgtacgtccgccgtctaccggtaccttataaacctcggtcattgccaatttagggaaaagtgcgctcgaagctggatcctgaatggaagcagagaaaacaacatatttcccatcaggagtaaaggctgaaggaatttccgaagcagagtgagtagtcagacgcttggccgcacctccttcggcaggcattacaaataaatcgaaattaccaaagcgatcgctggcaaaagcaatctgcttaccgtcgggcgaccataccggattcgattcatacgactcctgagtagtcagccgtacagcttcccctcccgaagtcttcactttataaatatcccccttgtaacaaaaggcaatctctttaccatcgggagaaatagtcacatcacgcaaccagagcggtgtcaccgcaaaggctgagaaagaacttgctcccaaagcaagcgttactaacaatttcttcatgaatctatatttttggtttccgcaaagatagcgattaaagcatgaagagaaaaaaaagtgaaaaattatttggattatattgacgaaaacatttatctttgcaacgttttccgaggaaaacaaataaagtttggactatggtgtaatggcagcacaacaggttttggttctgtttgtccaagttcgaatcttggtagtccaacggaaactctacagaaaagccctgaaagataactctttcggggctttttctatgataaaaactaaagggtaaacattccaatcggaatatatacccttctataaaaatatcacaatcaattttattattatttcttttcaaacaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgttcaaaagaacttacattcaatcagaataattcttgaggaagctttccatccacaaatttataatctacacccaacaaatgcataacataaggagctatgtctatctgtttcatagtctgcaactcttttcctttatctggaacattacagccatataccatgaaacaggtcggatcaatccctgagaaataaccatgagaaccacctttctttacaagaacatcggcgcccgtacggtttgtagagacactgattccagcaatcggctctaatgctaaagccactttaggatctccccccatagctgtcaattcttcttgagatacaacccgaaacaaacgacgtgtttcgacgggaagattttgtataatgcgttcaaccttttgaagagtttctttatcattagagtcacgaaggtataaaaacatcaccgaaccatttccatggaagcaagctttccagtcgcctcctggcttttcacttaacaatcccgcacgagtaagccagacattcggagcaatagcctgacttatatcagaaaaaccatgatcaccacacacaataactgttgtactatccatccgatgggtctgtttcaaattttctacaattaaaccgattgcatggtccacactcgcaacagccatccgagtgcgttccgattgcatacctgtagcatgctgggcataatctgtcgtaattaaatgaattgtcatcagattaggatgatatttattcatgatataattagccatatatgctgtacgggcatcacggttaatggatccagctccaaaagtcaaatggtctaaccgtccaactgcattttgttcaagttcatccaatatacctgacggagtacaaacaggcttaataaaatccaactggttggctacacgtttcactgaccaatattccggaatgttataatcaatccaacgtgatttagtcgatacaggccaaaacaaagaagctgtagtcaatccagattccttagcagcctgccagatagttggagcctttatactatccgcataccaatagcttaccacagaatctttattgaagacaaacggagaattataaaagatacgatgatgaacaggaagggctcccgtcacaatactagtatgtgacggataagtagctgtaggaggtactccctttaccttatccacaaaaagaccttcacgtttcatcatttttaaataaggagaaggcatttccggatcagttaccatccctgcatgcattccgtcaatcgttatcagtatgacatatttcgaattatcagcaacagcatccgacagccatcccaaacagaatagaatgacagcaaacaatctatagttcaatcgattaattaaagaacggcacaacatattcagatgatttattttcaacaattatcttattcatattataacggatggttacctttttagtcgtttcatccattgtaaagtcatccataccctgattcaatggaataaacgaaggaataagagcctccatatacggttgagccgacggcgtattagcggcctcaacctcacaaacaggtaatttaatacctaaatcggccactcttcttccctcagcaaagaagatttcctgacgcattaaatataataactctaaggtttcatctactccactggttttattgatcatctcttcagaaacagatgttccagaaatatacggaacgctgattaaatgaggagcctgacggtctaaaaccaatccgctacgatattcttcaccttcagaagccgccacaacatattccgaactgttgggataatgtttataccccccattaaatcttccctccagctgatcattcaaatctgtttgaataggacgagatttaaccaaagtaagcaattgcttcatataacctttagctccatcaatatcgttatcggataaagctgcttctgccaaaataaggtaatcttcttcagcctttcctatattaataggacgttcttccgtactggttagcttaaaatacttaggatccaagaaatccaatctcggtaacggctggaaccaggttccccatgtagcagtctgaatggaattcagtacgtcgtttaccccatcaaactgtacttgtttcacaaaatcaccagaaaaggacaaggctgtttgagattcattcacagcattttgtttatcgcccaagcgataataaacacgtgctttcaaggtatggataaaagctttgtcttcatctgtttctacatactccaaagccttgtctaaaacctcaacagccgttttcagttgctcatcccatgtcttgacatcccctccatcggtatcgggtaaggcacgaaaatattcacccgcaagaatatatgcataagccttaatgtagtacagattaaacaaatcgcttttcgttgttttggcatcaacaggtgccacgacattgatgccataatctgcagactcacgcatggtacctatataccgctgaagatttgtaacatcaaggtctgtatacagaatcttcggtatatcgaataccttactactctgggaataattattgaaatagttatccgacataatttccatcagttcacaataagaacctatcgactcagcaaaagaactattcgctccatttacccaagcctgcatggcatttgccgaatttaaaaacgtattttcatcgacattcggattgataatatcatcaggctgcaataactcacaagaattaagtgtaaaacacgttgcaactgacaaaaatatataattgattgctttcatatgccttttattatttagaaattaactttaactgatcctatatattgacgaggagtagaataggaagaatagttcaatcctccggtagctacggctccttgagaacgagcacccgacaacaatgcttcaggatcgacagaagctgccgtaaaagagaatggattatatacattgaaaccaaaacagatttccttcagatacctcttcggcttaattgtataataagctccaatgtttctaatctttaaataatcagctttttcaacaaagaagtttgtaaaattcaaccatgcagcaccttgtgttgttccttcaagtgctttatctggtatactaggatcctttaaaccttttgcgaaacgaaactggcggtcgaaagaatgtacgtacgaccctgcctgataatcaccacttacaaagaatgaaagatttttataatcgacattcaatgagaaatttccatatagagtaggtatcgttgttcctaaatcttgtaattccaaaacttctttcagtgaaccgtcttcatttaaaacagcctttgaaccacgaataaaaccgacaggctttccttcttccactacggtctgtaccgtacgtgaagagaatccaccgattgcaaaaggaactgttccacccgtactcaaaacgacattgtgatttgtattagccgacgcattcagacgcacattccaatctttcgtattgaccagttgcatacctaccgtcaactcaatacctttattttcaatttcacccacatttgccagatagcttgcagactgtccggaagaaggcagcgaaggaacactaaagagtgcatctttggtacgagcataataataagttaatccaacattcaaaaaatgattaaacaatacagtattaaagcctacttcgtacgaatgtttcttttccggtcccaaatccggattaccatatttaccaaacgaagctgcctgctgacctaaaaacgaatttacagcaattgttttctgatactcaaaagcaggtggataactacccgcaataccataattagcaaatagtctgaaggaattcagcataccactgtttacaatggatttcataaacgcttcatccgacaactgataagataatccaattttaggataatattgccaacctacattatcaccgaatgcagtattatagtctgcacgcaaacctaagtccaaataatatttatctttgataccaatgttctcttgtacaaatacaccatagttatataaataactcaaccattcatcggcactctgtgtaccagctcctgtcattatcagcgcaccatccctaacattcgttccattgtatacagactgatgatcataagtgctgaaatactggaaaccagcagttgtaaccagactcagaatatcacggaaatgataattatattgtccgttcaattcaatggtaagccctaaatagttacggtcgaagttattgatactacctgcatccgaagttccttctggcttttgctgagtatgaatcaaatactcgtttgtcgtaatattcttattcgtattcaaacgatagtccaatccaaaagttcctttaaatataagattttgaagaggtttaaatgaaagtgactgtgatgtctgaaaacgacgcacagattctttattattctgcaaagcttcagctttatcgacaaaagccttcatctgggcaaattcataatcgcttgcagcatcaatatccggattgtaactaacggtatttccgctttcatctacataatcaaaattagcagcagcagaaccttccgtaaaccacaatcccgtatatcctccctgattaccattacggctacggcggaagtcttccactaccataccaaatgagttctgatactctaacgctttattaattttcagacgagaaccgaaacgcaaatcgtacttcttatcttcattcccgttatgtatcaaagttccggtactgttgctcatgctcgcgcctaagctataaccatatttttcatttccaccatcgaaagctacacgatatttctgtgagaaaccagtctgatgcaacaattctttcgtacgcttaaaatgataaaactgagaagatgcaacatctgctcccaactcagcctctacagaagcattaaaacgtccttcacctccttttttagtgaatatctgtatcactccgtttgctgcatccgaaccgtataatgtagtagcagcacctccggtcacatattctatacgttctatattttccattggaatatctccaatagaacctgtagcagcagcatttccactcaaagaattatttaatgtcgctcctgtattcatgttatccacacgtactccatcaacataaataacaggagtagaatttgaaaaagcagaagaaagaccacgagccttaattaaagaagtcgtacccggttgtccattcgacaaattaatctgtacattcggaagtgcattttgtagcatctgatcaatacgcccttgtggcatttttaccaaatccttctcacttacagtcgaaacattcgatgacaaacgtctctttttgatttcagcaccttgtccggtcaccaccacttcatccaatttgaaattgtcttcattcatttcgacaaccatcccttgtttatcttccgacaagctgatttcttttgtcacataccccacataagtcagctccagtgttgctttcgcagcattaacatccagagaaaaattaccatcaacatctgtaatagtaccaatacccggattaccctttacagacacagatacccctattaaagcctccttcgtactttggtctattacttttccttttaataaattggctgatgccgaaaaaggcaataagcacatgattccagttaaagctaaatacctcataaacaattctattaaaaactgttgcaaaagtacctgaccctcattacaaacaaacgacagagaaatgacgttacggttctaaaaacattgcaaaagatgtaaactttattaaaaagagattacaagtaccacaggtttgaaccaccgaaaaaagaattttccattttcctatatcaagtattcacgcttttagcgtatctttgctgactttaaaatgtaatcttaaaaagaaaggaataaccgtggctaaggacaatgacgtggtattaacccccatgatgaagcagtatttcgacttaaaggcgaaacatcccgatgcaatcatgctcttcaggtgtggcgacttttatgaaacgtattcggaagatgccgtaacagcttccgaaattctgggaatcacgctgaccaaacgtgccaacggacagggtaagacggtggagatggcgggatttccgcaccatgcgctcgatacgtacctgccgaaactgattcgggcaggacgacgtgtagctatctgcgaccagctggaagacccgaaaaccacaaagaagctggtaaaaagaggcatcaccgaactggttacgccgggtgttgccatcagcgacaatgtattatcttataaggagaacaacttcctggctgccgtacatttcggcaagacagcttgcggcgtcgctttcctggatatttcgacgggagaatttcttaccgccgaagggcctttcgactatatcgacaagttactgaataattttgccccgaaagaagtcttgttcgaacggggaaagaaaccgatgttcgaaggtaatttcggtagtaagttctttaccttcgagctggacgactgggtgtttaccgaagcgtctgcccgcgaaaagctgctgaaacatttcgaaaccaagaacctgaaaggtttcggagtggaacatctgaagaatggtatcattgcttccggagccattctgcaatatctggatatgacgcagcattaccagatcgggcacatcacttcgctggcacgtatcgaagaggataaatatgtacgcctcgacaagttcacgatacgcagcctggagctgataggcagcatgaatgaaggcggaaccagcctgctcgatgtcatcgaccataccatcagcccgatgggagcccgtctgctgaagcggtggattgtcttcccgctgaaagacgtgaagcccatcaacgaacgactggacgtagtggaatatttcttccgcgaaccggatttcaaggattttatcgaagagaagttgcatctgataggcgacctggagcgtatcgtttcgaaagcagccgtaggacgtatctctccgcgtgaagtcgttcagctgaaagtagccctgcaggcgatagaacctatcaagaatgcctgtctgaatgccgacaacgaaagcctgcggaagataggtgagcagctgaatctctgtgcttccatccgcgacaagattgccaaggaaataaacaacgatcccccgctgctggtcaacaagggaggagtaattgccgacggagtcaatcaggagctggacgaactgcgccacattgcttactcgggcaaggattacctgctgcaagtacagcagcgcgaaagtgagctgacgggcatccccagcctgaaaatagcctacaacaacgtgttcggctattacatcgaggtaagaaatacacataaggacaaggttccagccgactggatacgcaagcagacactggtcaacgcggaacgatacatcacgcaggaactgaaggagtacgaagagaagattttgggagcggaagacaagattctgattctggaaacccgtctgtacaacgaactggtggcagagcttgccgagtttatccctgccatccagatcaatgcgacacagatagcccgtctggactgcctgctgtcgtttgccaatgcagcccgggccaacaaatatatccgtccggtggtagccgacgacgatatcctcgacatcaagcaaggacgtcacccggtcatcgagaaacagcttccggcaggagagaaatacattgccaacgatgtgtatctcgatacggaaacgcagcagatcattatcatcaccggaccgaacatggcaggtaagtctgccttgctccgacagacggcacttatcaccctcatggcgcagataggttgctttgttcctgccgaaagtgcacacatcggactggtggataagatttttacccgtgtgggagccagcgacaatatctcggtgggcgaatcaaccttcatggtagaaatgaacgaggcggcagatatcctgaacaacctttcgccacgcagtctggtattgttcgacgagctgggacgcggtacatctacttacgacggtatttccatcgcctgggctatcgtagaacatatacacgagcacaagcgcgcccgtgcccgtacgctctttgccacacattatcacgagctgaacgatatggaagagagcttcccgcgtatcaagaattacaacgtttcggtgaaggaagtagacaacaaggtcatcttcctgcgcaagctggaacgtggaggaagcgaacactcgttcggtattcacgtagcaaagatggcaggtatgcccaagaccatcgtgaagcgtgccgacgagattctgcaccagctggaaaaagaaaaccgacaggaaggcatgtcatcgcatcataaggtagaacctaaaacagttcatcaggacggagtacagctgagtttcttccagctcgacgaccctgtactgtgccagatacgtgacgaaatactgaatctggacgtaaacaacctgactccgctggaggcgctgaacaagctgaacgatataaagaagatagtaagggggaaataataccctctacctgcatattatgattccctgtgctgccagaaaatgatactccggcaacacagggaatgcttattgaaaaggtaaaagagatactatcaacgggaatacagatgatataatacatcgttaaccaacgtgattgttaccaatgcacatacaactcccaacgagaaatatccatctactgcaaaaaataaaatccaccatacacacatggctccggcatccaaataaagatacttccctttatcgggacaagctgccttcttcttatatagtaccaacaaatcgaaaagaatagaaatcataaatagccccataagaagagcaagccacaaagcatttttttcaatactttccacaagtccataaacaacagccagacctaataataaggaacataccatcctgattttgaaatacgtgttactgctttgcataatgactaattttaacatggcaagtaagttaataaaaatcaaattaaaaaacaatatatataaagaatcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgaagaattatatatttaaactatctaatcttagatctataatttcatattttaatttttcacttttaaattttagtttgccaataattaaaactactttgcataatagcaaatgctattaataaggagtttttatcttctaaagttaaattaggtgaatcagacacaacctttctatattcatacaatataacctctaaatcctgttcattaacaacatatccatttacagcttgaaagaataaatccattattctctcactatctattgaaacaatgcctttttctacaaaattacttaataccttttcataatcattacttcgatataaatctattaaagtactatctatttgattgattaaatctaactgtatgttatcagttattaaaggaattccatagctattataattatcaatatgcttaacatcagtacctaaatcatctattggatcataaacacctctagaggaataatttgttgaagcatttaaagctatgccaactatagaatcatgtaataatgaaatagtatgacattcatcttcatttaatatcctttctaacggttggatgtcatcattcttcatcacagaagaatttattataacagtttctttataagattctaatacatctaaataaggcataaccattgaacatccacaatatgcagaatatgaagctccagcagatataacccctgtagaagtcaatacagcagcccccgtgacaggtccagctactcccccagtcatagctgttattagagctgcagccccaacagaagctttaaaacctgtataagcaccaatggcatctgcacttattatagcaataaaccgtccccaaatacctctactttcaggcttaatttttaaaatagaatcattaaattcactcaaagtattcagttcttcaacaacagataaatcatccacttttggttccaaaacagaatctttttcatttgaacaagcaaaaaagaataaacaactaactatcaaaaaaaaataatcttttcataaataattatatttaagataacaattaacaataaacaatcacaatacaaaatctccggtaatttcatttccctctttatcatagaaataaatattataattccccgatttatattgggatatatctattcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgtctattattacagtatcgaatgtcttaactgtaatctcattttgatagactataccctctgcaccagtaacgataaccttatatacagcccctttcaaaaataaaatatcaatagccgtagaagattgtgtcgcattaataggaatctgattttgagaaacagaaactggagattcattggttttcaattctatgtttttatctgcaaaagcatagtctgaaaaaagaactaaacccataaacaataaaaatatctttttcataaacattaaattattgattttcgctattacaaaggtacagcagattcaagcaccatacaaagaaaagagggtgacacaaggtagacatatacaaaatcataacacattgataataaatggaatataaaaattaataaagaaaaaaggtagacataataaaacagcaggcagtttatcccactattatcccccgaataatctattagcaattcaccgataaaacaatcaaattatttatatttgtaatagtcttacaaacattctgtatgaaaaataaaacactcatcatcattgtcaccatagcagcaaccgcagccgccctttcactcggcatttaccagaaaaggacacaccagataaatgcttcactgttgcagattgagcaactgatgtatgaaagacccgacagtgcctggaagatactacaacacatgccatccatttcgcaattacgtaaagaggaacaggcactccatgcactgctattcacacaggcacaatataaaaactacattccggtgaaaagcgattcactactccggatagcggaagcatactaccggacaagcagcgactccctgcacaaggcatggacacttttctatttggcacagtattacagggattcggatgaaaaggaaaaagcactctcgtatttccagcaggcgaatatagcaagccggaatatagaaaacaatcaattcaagttcctgctcaatttacactgggctaatttactaagcgatgaagatgccgagaataaaggaatcgaaaaatatcaaatggcaaataaatatgctattttactgaaagataccttaaaacaaattgatttatatggacaatggggatggtgctgtctgttaacaggaaaatatgattgcgcagacagtctgtttaatatgggattaaaattatctacatcttcaaaaatgacaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatagctgcaagtgatgcattaaagtggaatgccagtttcctgaagtctgtagactgacagtttgttattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctaaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgcaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttataatttactaaaaatcagtgaattatgcaatactttttctgttaattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgaaatgacatattataactacctattaaattgtttatctttaacggcaagagaaaaaaaagattacaaacgggcactggaactggtaaaccgcagtttatcgctcgcaaaggattccaccgagctatatccgttatggaataacaagggagaaatcttgctggagatgaaccaatacgattcggcacacttctatttaagcaaagatacgagagattatgatccatatttcaaagcgactcattatttaaactggagtatatacgaagaaaaaataaaaaatcttcccaaagcgctggaatacagcaagcggtatgccgaactgctggataccatctatcaaaaaaggctggagtctaaagtagtaaacctccagcacaaatacgactactccttgattcagagtgaaaacaagctgctgaaaatcaaacggcaaagactgtatatatcactgatagccatctgcatggcggtactgaccgtagctgtcatattcttctataaacgcagggaagagaagcgtaaactggcagaacagatgcgatcaaaagacgacctgatgaaggaaatgaggctgcaactgcaagaaaaaaccatcgacctgcatgctgcacaggaaaaaattatcgaaaaggaaacagctctggacaaagaactttcacaaagggaaaagatgaggagcgaatactcttcaaaggaggctgccatgagaaaggaaatcctgcgccacagcgaaatcatcagaaaaatggaacagctcaataaaatgagccagcaggataaaatacaaagccggtcggtagtgctctccgacgaggaacaggacaatctggcggaagttataaacatctgctacaacaactttaccgaccggctttggaaaaaattcccgacactgacaaaggcggacatctcgctttgctgccttatcaaaatcggtatctcaaacagcaacatgctttacctgctcgacaccagcaaggtcgccttgaagaaacggaaaaaccgcctcaaacacgacaagatgggtatggacgaaaacgattcgctggatgagtttatcatggaattctgacgagcattatgctcactctttcacccatacatgttctatctctacgacatacattttatggaatccgccatgtccttcaccgtaccagcggcttaccagtgaggcatcgataaactgctcgggctttatcatatcggcatacagttttctgcattccagtaccatacgtgcctgctcgtaggcaatgtttcctccgggagtggcaaaaggcttcagtccggtagccgctaccttgtcgatgtcgcgtcccgacttggaaccgcagattttatgtatatctttatgctcttcgcctaagaaagacagagtaagcgtttctccctcttcaataaactggtaggtataacgctcgggacggatgaaaataaaggctacaggctttgcccacaaaacaccggttccgccccagcttgccgtcatcatgttaaacttttcctgtgttccggccgttaccagcatccattccttactgatagcgtcgaacatgttatctttcagttccgatacatttatttctttcatacatgcatatatttaatgattcatcagggcaaaactactaaaattatcggtacccagagaaaaacgctttcagaagtcgctgaaaatttgtacaaacgtttttattttttgtaccattagtgtccaataaaaatggactagttaaaaaattaatcaaatagtccttcaaaaaggggataatcgagttctttgacatcgttgaaatcagtcttatcgaacagttcacgcaagttagttttgtccgttagagagatgcttagaatctgcaaaacttcataagttgagcgcttcaattgcatatcgtgttggacaatagccactagacagtaagtgatgattgctacactgatttgaatgcggacagcattttccgttgtgccccagaatctttttattttaaggtgctgcttgagccatttgaagaatagctcgaccaaccatcttttcttgtagagattagcaacgtccaatgcagaaatatgtgttgcgtttgtcaggaaagtgaactcacggtcaccctcttcatcatagtaacgaatgagtcggaatgactcgggatatttcttctctgagaggtatccggtcagtttcacttcagcatctgtaagtacatacttaggcatcctacgcttccatttaaccattgtgtatttcaagttcgtcttagctctgacaacgaaaaaggaacctgtcaggtgtatcctatatagttccttaaaagagtcataagccctgtcgaatatataataagcatttggttcataatggattgaacacatcgctgtagagtcgtgcttcgatgctgtggttacagtatagaaggcaggaacttgtgcttcaatgtcatataagacatgagctttgacacctcctttctttcttcggaacttcgcccatggaaatgtggctagacacaacggaatagttgttgaatcaaaagcatacttattccctggaatatccaagatgttggtcgctcgcttttcacaagcttccttcattatatagaatgcgaagtcttcaaagattctgtagtcacgattctgattagcataagcgagggtggctttggctattggattgcgtcccagaccaagatgatattgcttggcttgatgcgcttcaaaagctacaattaagtcgcgaagactctcacgattgctcagttgtccgaacatcatagcaagtaactgattccagcaggtgaattgtttcacgtagcgattaccattatacttgcgaacaaagttattgaattgtgttctgttcataaaagcggtaagttgagcgaatacgtatttatcttggttcataagcggcattcaatttgaccgctaagctacgaattcaaatccgtttcattctaaaatactgcttaaaagactgtatttcaacaatttcaaaggcccattaaccaacttttattggacagtagtgtttttgtacaaaaaataaaaaaacgtcagcacgaatcagacaggctctctgcatcttcctgcccgaacttcctcttttccctgtttcttttttttgatatttcatgaaactcctgaacgaaaggagtatacaaaaaccattttttaaatagcaaaactgtattaaaattcagaaaaaataaactatctttgccaccgattggttccggaaggttggttcgacccgacggattaaaagggaatcgggtgaaagtcccgaacagtcccgctgctgtgaagctcatcaagcacgttgacaattactcattgccactggataaaaccgggaaggtgtcaaagcgtgtgagtcagtcagaagacctgccatcgtttttattaattaaccgaactcgtgggataggacggttgaacgttttacataatgcttaatagactttactatgcggtaatgtttaccctgctggtgtggggtataaacatttgtgtaccggtacatgcacaaaacaagttggacagccttcaacatctgaacgaggttgttgtgacggcgcgtgccgtgcagaaagagatttttccagtacaggaattatcgggcaagcagcttcatcagctcagctcgcacaacgtggccgatgccttgcgctatttttccggcatacagatcaaggactacggaggagtagggggactgaaaacggtgaatatccggagtatgggaaccaaccatgtaggtgtgttctacgacggcatcgagctgggaaacgcacaaaacggtacggtcgatctgggaagattctcgctcgacaacatggagtctgtcacgctgtacaacggacagaagagtgccattttccagccggcaaaggattttggctcgtcgggctccatctatttgcagacacggacgcctcagttcgaggaaggaaagaagtataacgtaagggcttcgttcaagacgggttcgtttggtgtggcaaatccttccgttctgtgggagcaaaagctcggacaacgaatcagcagttcgttcagtgccgagtatcttcactcgtcgggaaaatacaagtttacttaccgcatgcaggagggatatgatacgacggcggtacggcagaacggcgacctgaatgccttgcgtgtggaaggagggctgttcggacagctcaagcagggatactggaaggcgaaggcttacctgtacaactcggaacgtggatatccgggggcaatcgtccgcaacaagttctcgcacgaggatcgccaatgggatacgaatttctttactcagggtacattcaagaaggactttacacagtggtacagcctgcttgccaatgcgaaatatgcatacgactatctgcattatctggccgaccctaagaaagacgagtcgctgatgtatgtcaacaaccattattaccagcaggaagtatacacatcggtagccaaccgatttaatctgttcccgtggtgggaggcaagcttttcggcagattatcagtttaacctgctgaatgccgacttgcgcgactttgtgtatccgcaccggcatacgctgctggcatccatcgctacggctatgcgcttcaagcaggtggaacttcaggcaagtctgctcgaaacgtttgtacacgatacgagctcgggcacgcctgctcccgacaagcagaagcttactccttcgtttttcgtgtcgtggaggcctttcccgcaaagtggcctcaacctgagaggtttctacaaacggatcttccgcatgcctacactgaacgacctgtattatacgttcatcggaaatatcaacctggaacctgagttcactacgcagtacgacttaggatttacgtacagccgtaccttcaacaatacgtggctgcgctcgctggaagtacagacggatgtgtactacaatgaggtggagaataaaatcgtagccactcctacgtcgaatttcttccgctggacgatggtcaatctgggcaatgtggaaatcagaggggtggacgtggtacttcagaccggctggaagatcggacgtgacctgatggtaagcaaccgaatcaattatacgtatcagcgggcacaggactttaccgaccccaaaagtgagttttacggaggacagattccgtacatcccctggcacagcggttcggccgtggtgaacctgcaatggcgctcgtgggaggctaattacagctttatctataccggagagcgttattcttcgcaggccaatatcccttataattaccagttgccgtggtataccagcgacttttcggtttccaaacgactgaaggtgtggaaggggaacctgaagctgacgctggaagtaaacaatttattgaaccagcagtacgaggtggtgatctgctatccgatgcccggcaccaacttcaagctgattgcccaatataacttttaatcattcggaccatgaacagatattatttttacctgacagcctgcctgattttgtgctttctggacggatgtcgtcaggagcttccgacgattcgttcggaagtggaatatgtcaccctgccttcggacccgcagtctatcgaaggattctttctcgtcaatgaggggaatatgggaagcaacaagtgtacgatcgatcattttgacgcacgtacgggaagctatttccgcaacatttatccggaacggaaccccaatgtagtgaaggaacttggcgatgtgggcaacgacatcggcatttacggcaaccggctgtatgtggtagtgaactgttccaactttgtggaggtgatgaatgtacacacggcagagcatatcggcagtgtgagtattcccaactgccgctacattgttttcaacggcgacaaggcgtatgtcagttcgtacgccggtccggtacagattgacccgaacgcgcgtccgggaaaggtggtggaaatcgaccttgaaacgctccagatcacgcgggaggtggtagtaggttatcaaccggaggaaatggttatcaacaacggacgactgtatgtggccaattccggcgggtatcgttttcccaattacgaccgtaccgtttcggtagtcgacctccagtcgtttcaggtagtcaatacgattgatgttgctatcaacctgcaccgcatggaaatggataagcagggacgcatttatgtcagttcgcgcggagattattacggcatcggctccgacatttatgtcgtcgactcccgcacggaaaaagtaaccggcagactgggtatcgccgctagcgaaatgtgcatggacgagaacctgctgtataccatcagtaccgaatggaactacaatacggggaagaaccagatttcatacgccgtttacgacacggagaagcaggaaattatttcacgcaacttcattaccgacggaacggaaaagaatatcaccattccttacgggcttgccatcaatccggaaacaaaggaaatttatgtatgcgatgccacaaactatgtcactccggggtatttatactgtttttcaccggcaggcaagctccagtggaaagtccgtaccggcgatattcccgcgcatatagccttttcgacagaaagattttattaaccaatacttaaaccgtttcaaaagatgaaaaagttcacattacatcaggttcagctgacgggctccttgcttgtcgcactggctgccggtggcttcacatcgtgcagcagtgacaaaaatgaaccggaaatgccttttatcacaggcgaaaaaacgccttacgtgacgcgtgttctcgactaccgtccggctgtagggcagtttaccaatcagctccccgaatataaggaaggagatacgcaggaagatatgaaccgtaaggcgctggaagctatcggaaataataaaatgggaatggtttcgctgggaggtttcggcggatacatcgtggtgggcttcgaccataccatcgaaaacaaggccggactgtgtgacttccgtgtactgggtaatgcgttttatgccaacggggcatcggaatacggaagctgtgaacccggtgtcattcaggtatgctacgacgaaaaccgcaacggactgcccgacgacggatggtacgaaatagccggaagctcttatcctgacggaaaagaatcgtggcttgacttggctgctcaggcaggcaacgatacgaaaaccgtactgaattatgaaataacctattaccgtccctcaaaggaaccgggagcgcctaccgagcagtatatccgctgggaggataatcagggaggcagtggttacaaggcgatgaacttcgctcacttgcagtcgtattatcccaaatggatcaaagaagacaagatgacgtttaccggaactcgcctgcctcagaacggggtagaccagagtggaaaaggtacgtattatgtgctttaccgctttgcttacggctatgccgacaatgaactgaatgaaaatgcggcttcggctatcgacatcgactgggcggtcgactccaaaggcaaggcggtgcatcttccgggtgtagacttcgtgcgtatccatactggtatcaatcaggaaaacggatggctgggagaatgctcgacggaagtcatgggagtagtcgatttgcatctgaccaatgttaccatagaaagcaaaaccatcaaaaacaaataatcaacctactaaaaacttttaagcaatgagaaaaatcaaatttatgaagacaaacatcctttgggggatacttttactgactgtcagcttgtttgtcggcagttgtagcaaagatagtattgcaccagcaccggaatttgagctggtaaccgaaatggatggaaccaatccgctgtttgtttcacccgaccaggttttcaaaattgaatataatgcaaagaacatcaagtcagttactaccagtacgttgccggaaggatggacagccgaaatagatgaaagcggcaagtatatcaatgtaaaggctacagccaatgctgtttcgaaggctaaactgacgattacggctacgggagaagatacacagaaggtatcgaaagaggtaacactttgctgtctgaacttcttcgacgacgtgaacggtaccttcgtgctgaatgaaggaaacatgacaaccgaaaacggttcgcttacgtatgtcactgccgacggctatgtcttcgacgatgcttacaaaacggtcaacggatcggaactgggtaatgtggcgcaggatatggctttctatggcgacaagatttacatcattactcaaaacggtgatgaaaatgcggtaggaaagaagttcgaaaacgacggtatgctgattgtcgtaaacgcaaagacactgaaaaaggagatagcgtttagtaagcaagaactctcagaactcgactggcctacgcacattgccgtactcgatgaagaacatgtttacatccgcgacaacaaaggtatacacagactggatacgaaaacaaagaaactgacaacggtagaaggtacatccggtgctcccaaaagccagttcgttaccatgaacggtaaagtatacacgtataaaacaggattattgggctgtattcttgagatttctccggataaggacaatgcgaccaaaataaatttcccatatagagtagagatctccatcaatgaagttttgggcatccaagctgccgaaaacggagatatctgggtaatgtcttttggattcggaaaatcggccatgaacaaattcaatgttgaaagcaaaaaaataatacagcgccagatcaatgtaaaaccgagtgtaggaagctctggagtagcatttgcaagttatgacaacaatatttattatgcagatggcacaacaatttaccgccttaaattcgatgaagacgaatcacttaatgcagcatcaggtcttgatgcagaagaaactttaaccgacttgtctgccatcgacaacaatgcaggattgctttataatggactgggagttcatcctgtaacaggaaatgtatatatcaacacgatcaaatcgtttgcccagtatactcagaatacaatctggtctttcgattttaacaatagcgcagaaaatcctgctgccaaatatgagaactatacgaacttccctgccggattcttttttgcacctggcaaataaaaacagtaaacttaaaaacattgaattatgaaactcttgaataacctcatcgttccggcattttgcggactactgattttctcaggatgctcggacaacccggaagatccgggtacacaaccaccttcgaccaatcccgaacctcctgcatatctgggaggatatgctgatcctgacggagtactgattctcaatcagggagctgcaatagaaaacagctcgctgacttacattactcccgaaggaaatatcgaacagaatgtatatcagaaagtcaacggatcggctttcggtcatgggggacaagacctctatatgcataacgggaaactttatattctcagcaccaataaggatgtatatcagaaacacgaaggtgacggcacactggtaatagccgatgctgtgacactgaaacgggagaaagcatttaaattcgacgaactaaaataccctcgtccggaaggatctttagacgaaaatgaatttcttccactagttactccactaagaaatattgtagtcatcgacgaaaaaaacatatttttctcagaccagaaagcacttttccgatttgacagtacgaccggagaactaaatatagtagaagattcctaccatttcggtaatcagggaaatacaattgaagctgttgccggcactcaaggtatggttgtcattggcgactatatatataccggtggaggaggattctgggccagtacaagactgctggagtttaaaaaaggagaaaacaaggcaacccgtatcttgccagatctcaaaggagaattcatcagtggtgtatgccagacaggagagcgtgaaatcatgattgccacatgcggacgttcgggatctactaagagctattttatatttgtaaatcttgatacctgggaaatcgtaaaggaaaaacaagtttcggccgacatatcagccgagttcttcgatactccgggcattgctcttgcaggagattatgtttatttctgtgccggaaaaaccagcgtcagccgtatttcactcaagacatggaaagtggaggaaaatatcatagacctgacaaaggatgctccgaatgccaaatatttaaactgcaatgctatagccgacccgataaagaagtatctttatgttgccgtttcggatgaatattatgaaacaactatttcaaacggaaacctgctggtatacgactgtagcggagaaactcctgtactagtaaaaaacatcgaaaacaagacaagctatcctgtcggaatttatccgatgtcgaaattctataaataaacagctttatcaatcaccactgattatccgaagagaacagaatctgttcctgtctttctgataattggtggtgatttttatttatgcttacactcagaaccattccttgaaagctggcacacgagctttactgataataaccttttcatttgcagcaggagacagctgtaaaaccatacggccaccaaaccacaaactcactccagtaattgccttatgagcaataatatactgacgattggctctgaaaaactgccggggattgagttgttcaaccaactcatcaagtgtttgctggaagtcgaatatttcagcagattgtgtaactgctttgacggctccttcatcgatataaaaataagaaatctgttctacaccgacaggaacgaaacgatcgcctttcacgggaaccagaaagtgtgtcttatagctttcttctcgttttaaagcatgcattacagcctggaaatcaatagctggctgaaccgcacctccaagaattttcaatttatcaatagcttgttgtaaatcggaactgctgataggcttcagtaaataagcgatgctattcactttaaatgcttgtaaggcatactcatcgtaagcagtagtaaaaatgatagggcaggtaatatcagtttgttcgaaaataccgaatgcagaaccatcggccagatgaatatccataaacaccaggtcaggcatgggatgaaaggcaaaccattccaatgttcctgttacactgtctgtttcacctacaatctcaaattcagcatcgacttctttcatggctgccttcagattacggagagcagctttttcatcttctataatcagcgttttcatatcagcggcaaagtaactttaaaaatcttttcattctcttcgatggtaatatcccgtttaaagagtaactgataccgcttcgacaagttggccagtccgatacaggtactgctactgtccgacagtttcggttgaatgcgattactgacacaaaggtcttttccttcagcgtagatgcgaatggtaagagggtttcggttgctgatttcgttgtgcttcaccgcattttccaccagcatctgcactgccatgggaggaacttgtcgttgcaacagctcctgtggaatatcaatatcgaagttcaggttgtcttcgtaacgcatctgcaacaaatagatgtacgaacgcacaaaactcatttcttcgtttaaggctaccgtatgcgaaagattgtcatgcaaggtataacgcatcacccgagaaagttcctgaagatagttctgtgccttatcgggcgactccctgatgagtgaatataatgtattcaacgaattgaaaagcatgtgcggattaagctggctcttcaaggcttcgtactgattgacgagattttccgtacgcaactgttcattctcaagcagcattctccgactacgctggttctggtaatccagatagcaagtgccggtcacgatgcaggctatcagaatatctcttaaaggatgtagataatgatgcaacatggcagtaatggcaggtacatcgaaatgctgatgaagatacacaaaaccttttcccaacaggttacatgccaccaaggtgattacaaaagttatcgcaactcttttccatcctaagtctgctgccggatgagtcggtatcatcagtctgatattcaggaaaaagagcagtaggatagaaatataagtaaacagtatttcggaactcacattcacccaataaacatccggaaacaaacgactgtctgtcacaggatcggaaagtgcaatcagttcgggcagatgcataaggaacgccaccaggatagagatggcgttcagcatcagaaaaaatcttttatggatgtgaaacaacttcatgcaacaaagttagtgttttttatccgttatcttggcggccacatacattcccggacggaaattcggataggcttgcaggatacgtgcataaactttgatggaacgattcacgttgtctaccatctggtcgactgaaaccagttcggccgtaaacgttgtgtcaggcattccgttcactttgaatgtgaattgtgtattcggctgtagcttgtccaggtctttttcgtaagctgtcaactgcaacatgggcttgcttttatcgatgacatcacacaccggatcgcctgccgcaaaatactttccggcattaacatccatattggtcacataaccgttccggggagcccgcacttccagataagtgcaaatacccttttgaagcagcgtagaggtatcaatacccaacaacgtaagctgtgcagcagccgcttccatcttactcttcatagaaagatagtcggccttgctttgctgcatacgcttcagtgaagccgattcaccggaaaccagtttctgctgacgctcatattcttttttcagatactcggtctgggcagcagcatcaaggtaagattgctgaagttcgatgaaagccggattggccaacgtcaggataacttctcccttgcgtacatattcacccggcaatacacggatatcccgcacagaacctcccatacctaatgttactgtcacatggttttgaggaggcatcatgatgataccgttgaacgatggcggattggctacattggtagctccgcttacgccatctacttcagacattgatacgctgtctgttgccgtttgtatcgtatcagcagattcggtggtttgctgactcgaaggacttgaacaagatactgccatcaacacgagcatcaagtaaatcattcgttgtttcatcagatttattttattcattttctctaagtttttaaagttggtatagggtcgttaattcattcggtataaagttccagttcgagtacggtaatgttataagcataaaccgtttcgatatatcctcgtttgatttcacgggcagcattcaggctctggataaattcactaatattggtttcgtttgcctggaatttcttcagtgcactgttctgcaaagcttctgcttccttgatagctgcatcctgatagtaagtcagtcgctcacgctgacgaaccagttggctttgcaattcactaaccttattcgacaactggcgacgatttgattctgcctcccagttggctatccgcaaattgatgcgagcctgtttggtacgactatgctgcggaaagaacagcaccgggaacgatactcccaccatccatgagttcaatccggtaagcggcgctatcttctggcgcacatagcctacagaaaattccgggaagaaacggctacgttctatcttcagcaaattctttttctcttgcacctgagcctcaaagtagttcaaatgacgggaagacaacgacagaccatctgtctgtatcggcatgactgccagcgacgtatcggcaggcagcagagcctgattgctgtagcaagcccatgtaaaccgacgtccggccagtgtcagttcttccgaagactccatccagcgcgtatacaagtcggccgccagtgctgtcatcatattgcgttcggccagatcgatatcgccttgagcataacgctgctccccactgttcttcagtcgttcggccagttccttctgtccactatacaaggtattcaactgataagcatattggtaataggcccatgctcgcttcacttctgccgtgatttcttttttcaccatgtcacgatagctttctcccttactgatttgcgtattagccaacgcattcttgtagaaaggagtcagcaaagaaccgatggattgttctacagacaattcattgtcatttcgttcggcaccgttcaattgtccccaagagtagctgaaagaagtacttcctccgtcccatgcctctcctttcgaggcacgtgcccgctcaatctcagattctgccattttcagacgtgggtggttggtcatagctgtttcgatagcttgttccagcgttatgcgctgctgagcctgtacggcaggtacaaaggctacaagcaaagcaattaccatagcagctttacgcaaagacaaacggtttcttctacgcaattgtcttacggcgatactgttcaccaaccggtagaaaactggaatgataatcagggtcaatatagtcgagacaatcagtccaccaatcactacggtagccagtggacgctgtacctcggcaccggcagattttgcaatagccatcggcacaaagcccagtgaagccaccagtccggtcaggaagacagggcgaagcaagtgcggacaaccctctgcaatgatacggtcggtacacaaatgatactggttccgcttacgtatgtcgttgaagtggttaatcatcaagataccgttcaatacagccacaccgaagagtgcgatgaaacctacacctgccgagatactgaagggcaatccacgtagccacagggctacgataccaccaatcagtgaaagaggtacggtagagaagacaaccagtgaatagatgacactcctgaatgcaaagaacagcaatagcaggatcagcatcagggcgatagggataactaccgtcagtgtactgatagcattctgcaaattctcgaactgtccaccgtattcaaagtaataacccggttttaacttgacattcttatcgagcgattccttgatttgctgaaccacctgctggatatcagcatcacgaacgttcacaccaatgactacgcgtcgtttagttgcgtcacggtttatctggagcggaccgtttaccagttcgatgctggccacttcacttactggaagctgaatattgtctttggtacggacaaacaacttatcgatattgaaatcgcttactttattcttatccagacgaactacaagatcgaaacgtcgttcattttcgaaaacgacacctgccgtttcacctgcataggctgtacggataacggcattcaattcttctatatcgataccgtagcgggcaatcttggcacggtcgaaatgaaccagcagctgaggcaatcccatagcctgttctaccagcacatcggatgctcccggtaccttttctacatatttagcagcctcacgggctttatcgtataattcagtcatatcttctccataaagtttgattgcaatatcagccttggcacctgtcatcaattcattgaaacgaagctgaataggctgactgaagttgaattctgcacctttcaccgaatccagacatgctttcattttttccaccatttccgcacggctcgaagcagaagtccattcgttgaaaggcttcatcacaatcatcacatccgcatcttctaccgccatcggatcggtcggcacttctgcggtaccaatcttggccactacatgcttgatttccggaaaacgttctttcaatctcttttccgcttcgagtgacacctcgatactcttgctcagcgaactgccggctggaagagtcatctgcatggcaaagtctccttcatccagcgtcgggataaattcggcacccaatttcgtaaacagcagcaacgaaagcagcaaagctatgaaagctacagaaatagttccccatacatgggccagactgaaatgaagcacgcgctgataaactctgttcaaacgctcgaagaaacggtcggcgagtgtctgttttaccgttacagtccgtttcaagaaaagagaagccatcatcggtacataggtaaccgacagaagcagagcacctatgatacagaataccagtgtcttggccatcggggtaaagtattttccttcaatacctgtcaatgtcaggatagggaagaatacaatcagaataataagtacggcaaacgtagcacttcttacaacccgtgaagcacctttttctacttcattatccatttcctcacgactcagggtacgtcctctcaactctcgtccgtacagatgagccagaattccttccagaataacgatggaaccatccaccacaataccaaagtcgatggcacccaaactcatcaagttcgccgagacattgaatatacgcatcaagataaaggcgaagagcatagccagcggaatgactgaagcaacaatcagaccagcacgtacattgcccaggaaaacgatcagtaccaggaatacgataatcgctccttccaccagattgcgtataacggtagatatgtttcggtttaccaattccgaacggttcagataaggttctaccgatataccttcgggcaacatctgctgcactttggcaacccgtttttccagttccttggttacgacattcgcattggcacctttcagcatcatggcaataccgcccacacattctccctcaccatccttggtcatggcgccaaaacgcttgggagctccaaaacgtacttgaccgatatctccaatgtgtaccggtataccgccacggttagttacaacaatctgctcgacatcgtgcaggttgttaatcataccttccgaacggatataataggcacgattcactttttctatataactaccgcctgtattctggttattacggctcaaggcttcgaacacttcaccgatagtaatattcagcgaataaagcgcatccggatcgacagctacttcgtattgcttcaggtaaccgccaaaactgttgatttccacaatgccgggaatacccgaaagctgtcgttttacgatccagtcttgtatcgtacgcagttccatggcatcgtaacgatcttcataccccggagctactttcagtacatactgataaatttctcccagaccggtggtgataggcatcagttcgggagtacccagttccggcggaatctcaccggaaaccatttgtatctgttcattaaccagctgacgggcatccaaggtaggaacactctccttgaaaacgaccgttacaagtgacagcccgaaacgcgatacggaacgaatttcttcgacgttcatcacgttgctcatggctatttcaataggaaaagtaatcagctgttccacttcctgcggagccagcgtgggcgacacggtaacaatctgcacctggttgttcgtaatgtcgggtacggcatcaatgggcagtgtcagcatggagtatatgccgcccgccagaagcagcaaggtggtgagcaccacaaacagcttctttcggattgagaaatgtacgatttttgcaaacataagtgataaatactaaatttataattattacaaagttaatttctctacagtattatttccatcttttaccgttgaaacgtccaaaatgacagttgaaatacacgataggcgaggtgattttatttttgtgatagtaccaattcatcgaaaaagacaagaaaagcagggaaaagtgttttttgagcctgattttttcaaatagaaatgcttactgacaaaagacttattatgctgttgaaaaagttgcttgttatatgtagacagccaatccaacgctatatttcttatgcaatgcagaaggtatgtttatcggaagaacaaaagaatatataaataaaaaagccccgattcttaaaagaaccagagctttccaaatttctctttctaaaagagcggtgcgtacgggactcgaacccgtgaccccatgcgtgacaggcatgtattctaaccaactgaactaacgcaccattaagttttttgttttgttgctttctctctcgattgcggttgcaaaggtacgactttttttgaaacctccaaatattctgcctaactttttctcatttttcttcattttttcgtcaaaatatgactaaaactggccttatatgctctaaagccctctttttctcctttatttacccagacatcccattgtaaacctgctgatgttttacatagaatttgtacaaaagatttttgaatttgtacaaatttcaatatcgtttgtacaaaagatcgtagaaaagcctccatctttttcaaaaaaataaaggctgttgcccgaaaacaacagcctcacagtgtagaaatgcaaatatgactaacttttattattttatacgtttatatccataaacagccaaatcgcccaactcttcctcgatacgtaacagttggttgtacttagccatacggtccgaacggctcaaggaaccggtcttgatctgaccactattcgtagcaacggcaatatcggcaatagttgcatcttccgtttctcccgaacgatgggaagtcaccgtagtatatccgtgtcggtgagccatttctatggcatcgagtgtttcgctcaatgagccaatctgattcaccttaatcagaatagagttggcgcatcccagttcaatccctttcgaaaggaattctacgtttgtaacgaacaagtcatcacctaccaactggcagcgtcctccgatacgttctgtcagtttcttccagccatcccagtcgttttcactcataccgtcttcgatggagtcgatagggtatttgctgataagttcttccagataagccacctgctcatccgatgtacgcttctttcccttttcaccttcaaagattgtataatcgtatacgccatccttataaaattcagacgaagcacagtccataccgatcatcacatccttacccggttcatagccagccagcctgatagccgccagaatagactccagcgcatcctccgttccgttcagggcaggagcaaaacctccttcatcgcctacggctgtactcaggcctctgtcgtgcaatactttcttcagagcatggaaaacttcggctcccatacgcagtccttcacggaaagaaggtgctcctaccggacgaatcataaactcctgaaatgcaataggagcatcactgtgcgaacctccattgatgatattcatcatcggaacaggcatcacaaatgtatttactcctccaatatagcgatacaacggaatattcaggtaattggcagcagcctttgccacagcaagcgaaacacccagtatggcatttgcccccagatttgatttagtttttgttccgtccagctcaatcattttcttgtcgatagcccgctgttccagaacagaccagcccaccaatgccggagcaatcaccttatttacgttttcaacagctttcaacacaccttttccaccgtaacgatgagggtctttatcgcgaagttccaacgcttcattctcgccggtagaagctcccgaaggaacagaagcacgtcctactacacctgattccagctttacttcaacctctacggtaggatttccacgtgaatcgagtacttcacgtcctataattgctttaattttcatattcttttccgtttaaagattaatgatttctctgattacaaaaatcagaaattctgaaagacagcacaataccttaaaataggtattttttcaggcataaaaaaacgcagaactcgtaatattaagtcctgcgccattcttgtgcatatccctatattaataattgttcttcttaacttcaaaatatgcttgtggatgcaaacatgcaggacaaatttcaggagcttccgtacctacatataagtaaccgcagttacggcactgccatactacttcagcgtccttcttaaataccttaccttcttctacattctttgcaagagcaagatatctttcttcgtgtcccttttcggcaacagcgatttcacgatacatcttggcaatagcagggaagccttcctcgtcggcgatatctgcaaatttcggatagtccaaagaccattcttcgttttcaccggcagcagcagctttcagattttcgagcgttgtgccgataactcctgaaggatagcttgccgtaatttctaccatgccaccttccagccacttgaacatacgcttagcatgttctttttcctgatcggctgtttctgcaaaaatagcagcaatctgttcgtagccttctttcttagctgtacttgcaaaatatgtataacgcattcttgcctgtgattcaccagcaaatgaaatgcctaaattcttctcagttcttgttcctttgatactttttcccataatcgttagttatttaattggttaaacaatgtatattcctgatttgacattacaaagataatacttttatccaaatttataatcattacaatttttaatttaagtattattaataaaaatcatctgctaatataaataataaccttattatcaggcaaaatgttcaaataaatatatacttttgcacttctttttataatttataacaaaacggatatatggtaaaattagattttcaaccaaagttgttttctacgttgaaaaactatacgaaaacagactttactaccgacctcatggcaggtattatcgtaggtatagtagcattgcctcttgccattgcgttcggtatagcttcaggagtaagccctgagaaaggtattatcacagcgattgtagcaggattcatcatttcatttttaggaggaagtaaggtacagattggaggaccaaccggcgctttcatcgtaatcatttacggcatcatccagcaatacggcatcgaaggactgatggtggctactatgatggcaggtgtactccttatattattaggcatattcaagttaggtacaatcatcaaatttattccttatcctattattgtgggattcaccagtggtatcgccgttactatttttacaactcagatagcggatatcttcggtttgcagttcggaggtgaaaaggttccgggcgactttattggaaaatggattttatattttcatcatttcgacactgtaaactggtggaatgtgatcgtcagtttggtaagtatcttcatcatcgccatcactcctaagttctcgaaaaaaatccccggctctctggttgccatcattctggtaacagtcggcgtatatctgttgaaaatgtatggaggaatcacttgtatcgatacaatcggtgatcgcttcagtatcaaggcacagcttcctgaggctgccgtaccagcattggactgggaagctatcaagaacctctttccagttgctattaccatcgctgtattgggagcgatagaatctttgctttcggctacggtggctgatggtgtgataggcgaccgtcatgattcgaatactgaattgattgcacaaggtatagccaatttcgtttcgcctatcttcggaggaatcccggctacaggagctattgcccgaaccatgaccaacatcaacaacggaggtaaatcaccggttgcaggtatcgttcatgcagtggtattgttactgatcctactattcctgatgccgcttgcccaatatattccgatggcctgtctggcaggtgttctcgtcatcgtatcatataatatgagcggctggcgtgttttcaagggattgttgaaaaacccaaaatcggatgttacggtcttgttgataaccttcttccttaccgttatcttcgacctgacggtagcaatcgaagtcggcttggttattgcctgcgtactgtttatgaaacgtgtaatggaaaccacacagatttctgttatcaccgatgaaatagacccgaacaaagaatcagatctggaggtacacgaagaacatcttatcatccccagcggcgtagaagtatatgaaataaacggtccgtatttctttggtatcgctaccaagtttgaagaaatcatggcacgcctgggcgatcgtccgaaaatccgtatcatccgtatgcgtaaagtcccgttcatcgattctacaggtatccacaacctgacaacgttgtgtgaaatgtcgcaaaaggaaaatatacatatcattctttcgggagtaaacgaacgtgtacatgccgtactcgaaaaatccggcttctatgaattgctgggtaaagaaaacatttgcagtaacattaacgaagcactggaagtcgctacaaaagaaatagcagagttcaataaggctaaaaagtaagggctatagtgttaaaaccttttagcgaataagcggaacttattaaaacatgttataaagcatagattttaataagtttcgcttgtttgtttccagaaagtccgtatctttgcattgtgtttttcatagtattagatttaaggttaacaaaggttggagtacagcggtactccttttttatgtccttttgtgaagaaaccgtccattatatgaaaaaagctaccccaaacattctttgagatagccttctttcaatactcaaatattttctttttaataagatgccgtagcacttaaacccgcttccttgagcaataccacaatacgatccaattcttcgtgtgtagccttttgcaggaaatggtcaggagtttcacggtctatcgtatagatcatgacctgacggggagcaatctgttttacaacttccagccatggtaatacaaaacggtcggaagtattgtctatatccaaaccttcgtcggttttgcctttcataaacatggtctgaatgatcaagttacccttaaaggctttcaatccttcgataatcttgtttacatcgtaagctccggtaggtcggtctacccgttgaatatactccgcatccaccgtatcgagctttaatatgttattatcgatcttattcaatgcttcgaacaccttttccttgtgaataaacgtagaattactcaacacactgacttttgcattcggaaaatacttatcgcgcaatgccaaggtatcttctatgatttccgggaaatgcggatgagcggtaggttctccattgccagcaaacgtcaagacatcaggaacaggaccattggcctgcatatcaatcaaacgcttttccaaggcttcacgtacttcttcgcgagtaggaagtttctgtttcggccgatgatctttattatatccgcattcacaataaatacaatcgaacgtacaaaacttaccgtcggcaggaagcaggtttattcctaaagaaactcccagtcgacgactatgaatgggaccaaatattggagaaggataaataactgttgacataagtcgtattagttttagtttatgaacaaaagtacacaatatattcttattaccacttcactttcagctgtaattgtatatccgacttacggtttccttgtatttcttctgttcccgaactgatccggtcacgatctttataataagtcaatccccattttccctgaattatcaaccgattcttataactgtatttcaaattgactgaccaacggctgcctcttccataaaaggaaggtatggaaaaagcatacaataagcccggttcatacatataaacacgtgaatcataactttgtgttcgaaaccaggctccactacataaaatctgtactggtacaaaagataggcttgtacccagcgtcccgttaataaaacctccgttcgaagatgatccgaatttataagctatatgcacgtactcggttgcagttttcaaccagaatttttcacagggtttatacgatagttgataatgcagacgctggcgaatataaggcaatacatattttttctcatcggctgaagtatagttcttcgctttattcttatagctatactttatcaacatagccagtgaattaataggtgaataactcaactggcataaaccatcgaaaccggatgtatgatctttatccacttggtatcttcgataaaagaaatgaaagaaatcgccataacatgcaatcttcagcttgctgaagaaactggattccagccctatataaatacccgtttcattctgtagcttggaattttctccaaaagcatctgcataaatagcttgatatcgtttatcataataccggttaataagtaagaaacttgtatgaacagccggtgaataactcaacatattcagtgtagcaaccttacccgatttatcgaaagcagtttctcctgaaaaaataaatttgtggaaaaagattttataattcattccgatattgaaaaaatatcgtccacgaggataatataaattataaggacgaaagtcgggattcaacactttgttgaaaacagtataaacacctgttaaaccaagttcaaacaacttttcattatatgataaattactaccaaccaactgattattgattgtattcttcttttccatatcctttttcaaccgatgatatccatctgttttcaacgatcttataaacacaccttctattcgtgcatcctgtttacgaaacgaatagaaagcagataaagtccatcgttttttcaatgtataagtagcagctattccttgtaaatagttgctttctcctgtagaactatatttggagattccttttccaaaccgattcatacttccagacaatcccgattttcccagactgaatcctcccgtgttgataaccagtccatatccaaagtctactcgataattacctatcgccaatgccttcagcttatctacgtcttgtaagaatacataagcagcataaaaatcatatccttttttattgtacttactgaagaaaggttctccggcatctttctcggctgtaaatcccatatataactgatttcgaaactgaaaccgataacgcagattatgataaaccggatctccataatacttacggttgggatatttctctaaagtttccttatcataatcagcatagccggatttcatgtacaatgggatatccacacgtgttaacaactcctgtttattatgtttcaacacgtctttccaataaaacttatcttcctctttatcagactttccaatataaataaaatcttccagaaactttctggtttgccagtccattccttctactcccaacagttctttcttactcaccatcggtccatatttatatatataatacaagatattttctatcattttatcagaaagaaaaggcaattgttccaattgttccttggtgatcgtattgatattgaaaggatgctctgccagttcactcagagattcatattgttcttgccatttactaatatcttctgcctcggaaatatcttctttccattctacccaattagactgagcttgtaagtcaaaaaccgaataactaattaatatacagagtataaatatctttattaataccttgttcacagcttttcaacaacctttataagttaaaaattcgtattatcaagacatggcttcattattatgcgtatttttgcgagcatgaaaaatagtgtatacatattactatttctgctggttgcttttacactgaaagccaatgcacaaaagcattctccatcgaacaccaagggatatatggttcccgtttgtgtatatcagggagatactataccttgtataacgctaaaaaacatatatgtataccctagactgagatttaaaaacaaaaaacaagagaaatattactacaagttagtccgagatgtaaagaaaacacttcccctggcaaaggaaataaacagggctgtgattgaaacatacgaatatttacagactcttcccaatgaaaaagcccgtacacgccatattaagatggtagaaaaaggtctgaaggaacaatatacgcctcgaatgaaaaaactcactttctcacaagggaaattactgattaagctagtaaacagggaatgtaaccagtcgtcctaccaattggtaaaggcatttatgggaccgttcaaggcaggattttatcagacatttgcagctctgtttggagcaagcctgaaaaaagaatatcatcccgacgatgaagacaagatgatagaaagagttgttacactagtagaaaacggacaactataactataatgataatcaataaattaacaagttatcaataaggttatcaacaaagaataataccttattcctccggtagcaggaacaaggtattacttatacttatttcatcattttattggcaaattcccatagaacaatacctgcggtaaccgaaacattcagtgaatgcttggtaccatattgaggtatctcaatacacccatcacacatgtctactacttcctgctgcactcccttcacttcgtttcccattacaatagcatactttttatcagcatccagaacgagttgatccagcatggtactaccttcacactgctcgatggccaatactgtatatccatttgcatgaagctcatctacagcatcttgcgtacgtttgcaatatttccaatcgactgtatattctgctcccaaagctgtcttgtgcatttccggatgaggaggtgtagccgtaattccgcacagataaatacaattaaccaaaaaagcatccgatgtacggaaaacagcccctatgttatgcaggctacgtacttcgtccagtactactaccagcggaagttttcttgcttccttaaattcttcaaccgacagacggtgcatttcggttattttcagttttctcaattcagacataatttactctttattccgttcacaaagataggaaactatatttataaccttgttgaaaacggtggaaaaggtgtaaaaaaccaaatcaaagaaaatgaaaaataaatcttgcattatccaatgaaaacattataacttccagaaaaagaacaatacaagaaacttaacagaaagtttcatcagtagtttaaacatattttttagctgaaaatcggaagtaaataagtggaaagtttttaactttgcgatatatcaacaaatggttaatagaaacagtaaaactaataatatcaggatataagcttgttaatggctatctaatatctccttatcgaatatttataacctaaaaaacaagaaatctggtattctttttactaacataattaacgccctattataactatcatatattctttcaaaaaagaagaaaaaatataatctaataatgaataaagaagaatggttgaaaaagggttatgtgactgaacccgtagataaggctctcgatttgaaagctgaaattgacaagttgcgtaaagagaaaaacgcagtcatcctcgggcattactaccaggctgacgaaatacaggaaatagccgattttatcggcgatagtcttgcacttgcccagtgggcagcaaagaccgatgctgatatcattgtaatgtgtggagtacactttatgggagaaacagcaaagatattgtgccctgataaaaaggtcctgatacctgacctgaatgccggatgttcacttgccgacagttgcccggcagataaatttgctcagtttgtcaaagaacatccagaccatacggttatttcatatgtcaataccagtgcagctgtaaaggccgtaactgatgttgttgtgacttctaccaatgcaaagcaaatagtagaaagttttccaaaagaacaaaaaataatctttggtccggataagaatttaggaaattatatcaactctattactaaccggaatatgttactttgggatggagcatgtcatgtacatgagaaattctctgttgaaaagattatagagttgaagaaacaatatccggatgcggatgtattggtacatccagaatgtaaaggagcagtagctaaactggccgataaggtaggatcgacagccggattgttgaaacatgccatggcaagtgataagaaaaactttatcgtggctacagaaagtggaattctttatgagatgagaaaaaaatgcccggataagaattttattccggctcctcctgaagatagtacctgtgcatgcaatgaatgtaacttcatgcgtttaaacacactcgaaaaattgtataatacattaaagtacgagtggcctgaagtaaaagttgataatgaaatcgctgaaaaggcagttcggcctatcaagaagatgttggaaatttctgccaagctcggattgtaggttaattgttaaaaagagagtgataaagataggcttttcttaaaacgtgttataaagcatatttttatcactcttttttttgcttgttttctaaatgtccgtatctttgcactgtgtttttcatagtattagatttaaggttaacaaaggttggagtacagcggtactcctttttttatgtctatttgttccaaaaatatttttgaataccagttattccacttctttggtcgttttttacctttccttattcagctcatcgcataattttgcatatagaattttaaatcttaagtcgatgaaaaacaaattaatcaagcatttcagtattgttagttttatgctgatgatactctgtgtgcaaagtattttcgcacagaaaagaaccgtttctggtattgtcactgattcaaaaaatgagcctcttatcggagttaatgttaccattaaaaatgcttctactacaggaactattacagatatggatggtaagtatacattagatgtaccatcgaatagttctgtattggtattttcgtatataggatactcttcacaagaagtgaaggtaaataatcgatcggttatagatgttgttttaaaggatgatatgcaggctttggaagaggttgtggtagtagggtatggtacaatgaaaaaatccgatttaacaggttctgtttcttctataacaagtgataatttcaaattgggtactgaccttactccacaacaattgatgcagggagcattctcaggtgtcaatataagtcaaaatagtggtaagcctggaggttctaacacaattcgtgtacgtggaggtacatctattacagcttcaaatgatcctttgtatgtaattgatggagtacctatttcaacctcagctggagtaaatcaaagtaatataggttcttctactaccgatttttttgaccaagaacctattaatccgctttctaatattaatccaaatgatattgaatcaattaatatcttaaaagatgcttctgctacagctatttatggttccagaggtgctaatggagttattatgattactacgaaaaaaggaaaggctggaataagacaattagattatagttttaatttaggtatctctaatgttgctaaaaaactggatgttttaacaggtgatgaatatcgtaatacggtatctgaattaggtctgactttagatgataaaggagaaaatacggattggcaggatgtaatttttcgtactgcaatcagtcaaaatcattatgtttcttttatgagtggtagtgaaaacactagttatcgtgcttctgctggatatagcaatcaaaatggtattatggaaggttctggtatgaaaagtgctaatgctcgtgtgaatattaaccataaagctttaaacgataagttaaagctaaatatgaatatcagttatggagaaactaattcagatcaagcgcctgtatcaaatacggtaggtagtgagatgggtagtagtatgttgtatgaagcttatgtttttaatccgacttaccctatttacgatgaagatggtgattattatgacgtgcctccatatcgtgtaaatcctgcttctttttctaaagaactgttggatgaacgtgctacaaatcaattcttgggaaatcttactgctgattggaatttttataaagcttttaccttacaagtaaatgccggttataacaagaatacaataaatcgtaattcttatatttcaaagagtaatttattgggaaatggtaataatgggtatgtaaccgtacagaaactatctgattattcgaaacttttagaaactatattgaaatataatcaaagtttcggaaagcataacattgacgcaatggttggatattcttggcaatatttttatagtgaaggtcagacaacgaaggcctatggatttttatctgataactttaaatggtatagcttggctgctgctcaaacagttgagtctattagtagttatgcggaaagtaatacattgatatctatgtatggacgtgtaaattataattatgcagataaatatttattgacagcaacaattcgtcgggatggttctagtcgttttggctctggtaataaatggggaatattcccttctgtggcagcatcgtggcgtatttcacaagaagatttttttcagaacgacattatgtctgatttgaagcttcgtgcaagtttcggtattacaggtagtcaggaaataggtaattataattctttaagtactttgggagcaagtacaaatggctatttagtaggaggagaaaaaataactatagtattaccccagcaatatactaatcctgacttaaagtgggaacagacggctcagactgatataggcattgatttcggatttttaaatggaaaaattagaggtagcatagattattattataaaaagacgaccgatcttcttttatctgtggcagttccttctccttcactgattactacacagatagcaaatgttggaactgttaccaatcaaggtattgaattagatttgtcatttgatttaatgcgtacaaaagattttgcttgggatgctaatttaaacttaagtcataataaaaatgaggttgtaagcttgtctaatgggcaatggacaggagataatatgcaagttgctccgtgtcaaggacaaggtttatctggtacatatgctcaattaattatgcctggtgaaccgattgggacattttatggtaaacggtttattggtgtagtggatggagtagaacaatttgctaacgatggagaatcggaagttataggttgtgctcaaccagatttgacatttggattaggaacgaaccttcaatataagaattggacattaggattgaattttcgaggaagcataggtaatgatgtatataactgtacagccaacaatttagcttatttaagtaatcttcctggtagaaatgtgcttaaagaggctgtaacgtcaggagtaaatcgtgatcaagcaaaagtttattcttcgcgatttatagaagatggttcttttgtgcgtttagacaatatttctttggggtataattttagtttacctaaattatatatttctaatgctagagtatttgtttctgcacaaaatctgtttatcattacaggatattctggtgctgatcctgaagttaattcagaaatatcacgtacaggagttgctccattaggagttgattatttaagttatcctaaagctaggacatttagcatgggtattaatctttctttctaacaataaaaagtaagtatatgaaaacaaaaaatataattaagttaatattcttatcattcttaggagttagtcctttaacttcttgtttggatcttgatgaagaattatatggtagattatctcctgaaacttattatcaaacagaagaagaggcattatcttcagttgttggtgtttattcgtatctttcgtatatgtcaagagctggaggtgatggatggcgaatcggggaatttggaacagatgaattcttctgtccaggcagagccagtggaggatggtatgatgaagggaatatggaaatgatgtcacataaagtaacacctaataatgaacgtatagctacttgttggggaacttatgtgtttccaggtattggtgctgcaaatgctgttatagctagtttggaatcttctccaattgtagataacttaaaaccattaattgctgaagtacgtgccttgcgtgcttatggatattattatgcaatggactattggggaaatgtacctgtttttacagaagctcgtgttgatcctaataatttacctaaaacaacacctcgtgcagaagtttttaaattcgttgtagatgaatttacagaagccgcaaaagatctgccttctattaaagaagttaataaaactgattattaccctcgtttaacaaaagagtctgtttatacagctttagcttcactatatttaaatgctgaagtttattcaggaacggcagagtgggataaagttgtaacgatgtgtgataatgtgattggtacaaattgttatgaattggaagataaggtaggtgattgctttttatctacgaatgaggctaattcaacagaaattattacagctttttctgtagatccttctaagggagtagatggtaatgaatttatattgtatgcacagcatgctttagatcaaaagaaatatgatcttccttttgcacctgcaaatggttattgttttacagatgaagcattgaacagatatgaagaaggtgatgaacgtttagagttacttgaatatgggccacaatattatcaagatggagtaacacctttgtgtgatgaaaatggaaatcagttagttttaaccactatcaaagatatgatttctgcacaagaaaatgagggatatcgtgtattgaaatattctcctattggagttgtctgggccggaagtaagggagataatgattatgttttagagcgttactctaatgtacttttaatgaaggctgaggctttatttcgattgaatcaagacttagatgttgctttagaattggttaatgaagtgcgtcgtcgtagtaattgttctgaatggtctgatttgactttgcagaaaatagaagaggagcgtgctcgtgaatttatttgggaaaatcaacgtagacgggatatgattcgttttggatctttcttcaataatacttggttttataaaactgaaaaaacagaatcttggagaggaatatatcctataccagctattcaaataacaaacaacccgaatttggaacaaaatcctaattactgatgatttataatgaccaagttacaatataaatatattgtagcttggtcttaaatttttaatattatgaaatttatattggggctaatatgtatattcttttctattgaagctttttctgaatctacatattataaagttgtcgcacaagatggcagtggtgactatctgacaattcaagaagccgtaaattctgtacttgtatatcaggaacaacgtagtattataaaaataaagcctggcatatatcgtgagaaattggttattccggccgcatggtgtaatataagtctgataggagatgatccgacaaataccataatatcttatgacgacaatgccaataaaaataatatggggacattcagtttatatacagtcttagttggcgaaaacggagcatacccacccacttagaacggcataatccacccacaattattgctaaaatgggcttgaaaagggcataaaaaacggagcatatccgttcatttttgctaaaaaatgcccaaagtcgctcaaaaaacggagcatatccgttcagtggtttgtgattacgataaaatatccgttttactatacaaaaatcggagtatatccgttcagtgatggaaatgtaataatacaataatcagttgtttacattcggaaaacggagcatatccgttcactttctcatagaaacgacgatgcctgcataaaaaacggggcatgtccgttcactttccactctttcccgtatcttgtatgcagaatataatcttcatacaatacgactatggcaggaaaaagtaagaatatgagccagatcaaacaacttcttctattaaagaagaatggagtctccaaccgcaaggctgccgatataatcggcatgaacaaggagacagtgaacaactacatgaacaaggtcagcgctgacagcctgagccttgatgaacttatcaggctggacgatcccattcttgagcaccgtctcaagggcggcaatcctgcatatagtgacaaacgctttgaaacattcaaaacccttcttccatatcttcaggaggagatgaagcgcaagcatgtcacgctgaagcttctttgggaggaataccgtaatgagcatcctgacaaccactacagcctgacacagttccgttttcattacaaacagaacacagaggccggaaaggaatcgccatctaccatacttgctgacatgcgtactggcggtgaaaagcttttcctcgattttgccggtgataccatgggatacgttgatatggaaaccggtgaggtcgtccagtgccaggctttcgtagccactctgcctgcaagcgactacggttatatcctcttcgtacgttcacaacgcacggaagactttgtatatgccataacacagtgcctgaaacatcttggcggcgtaccaaagatgcttgtccctgacaaccttaaagctgccgttgtcaagacagacagatatgagccttcgcttaaccgtgtaatggaggatatggccaatcattatggcacggtcatcataccggcacgtcccgcacacccaaaagataaaagcaacgtggaagggaccgtgaggcttgtctatatgcgtgtgtttgccgaactccgcaatgaaaccttccattcactggaagagcttaaccgggcagcctcgctcaaaatgaaagcgcacaaccagaaacgcatgcagaagcatccttacacgcgtgaggaacggttccttgccgtagacaggccaaatcttatgccgctgcctgacagggattttgagattgtgtcatataccgatttgaaggtgtcaaccaactgctgtatctatctcggacgtgaccagcactattatacagtgccgtatcagtatatatccaaaactgcacatgttgcatatacacgcacactggtaaaagtatatgtggacggtgaacttgtagccactcacatacgtgattacaacaggggaaagtatactattgtaaaggagcatcttgcaagcaactcccgggaatacagaggaatgagtgcaaaatcatacatagagcgtgccgagcgtgcatccggcatacttggagatgtaatccgccgcatattttattcttccacaatgcctccggagactcattacaagacctgcgacgggcttctaaacctgcaaaggagcagtgatccggccgttttccagaaagcctgcgagacagccctgaacgtagacagatgcagttaccgctttatacgctcactggtggaaagcaagtgtgccggtgtggggcagcctacatcttcctttgctcctccgcaacactgtaatatccgtgggaaatcacagttcaaatgacagacttctaacactcaaaaccaataacgatggatgaaattatcaatgctctaagaaaccttaagatgcccggaatggcacattactgggctacgatgcaggagacgcgacaggcagagtcgctctccttgaaggacggcctgcaactgcttatacaggccgaactggataaccggaatcaaagccggaatgcccgtctgataaaaaaagcacacttccgttatcacgcttccataagtgaagttatatatgacagcaagcgtggcgtagacaagcagaaagtgcttaatcttgccacttgtgactatgtgaaaaacggggtgtccatacttattacgggagcttccggtacaggtaaaagctggttgggtacagcgtttggtcatcaggcctgcatgaacggacataaggttgcctattataacctgtacaggctcttcgaggaaataagccttgcccgcatatccagtaccctgcatcgtttcttcgccaggttggcacagactgatctgcttatactggacgacttcggtatgaaagttcttgacggacaacagctgcttgactttatggagattatagaagaccgacatggacagaaagctactatcatcatatcacaactgccggttgctaactggtacgatgtgatgaaaggcaacacgactgcggctgatgcaatattagacaggctggtgcacacaagtgtgcgcttcgagttagaaggcagcagtatgcgtcaaaaaaaacatccaaaatataacattacagacgaaaatcaataaatttgcatcgccataggtttagaggatgaaaagtgaacggatatcaccgttttgggtgaacggatatcaaccgttttcagcacttagtgcatggtgatggtgttcgtttagaaaatctgacaatcgagaactcttctcaaatgcagggacaagcggtagccttacatttagaaggaacagagtcgattattataaattgtcgtttgttgggtaatcaggatacggtatttacgggaaataagtatggacgtttttatttttgtaatacttatatagaaggaactaccgattttatatttggtcctgctacttgttggtttgaaaattgcattatacacagtaaagctgattcttatattacagcagcctccactccagcttcacatccatttggatatatttttaatagatgtaaattgacaggagacgataatttaaacgtttatttagggcgtccatggcgtgaagctgcttatgctttatttatgaactgttatatgggaaaacatattcgtcctgaaggttggcataattggggaaatcctaagaatgaacagactgctcgttattttgaatataataacaaaggtacaggagctgatatttctagacgtgtatcttgggcacgagttttgactcacaatgaagctgaccgtataaagattgatattgtttttccagatttaaaagaatggagttcttatcatactgtagagactgaaaaataatctgctataaggaaataccaacttgatcattgcaagttgtatttccttatataaatgaggctataataaatattacttatcaatgctatttttgtattcggtaggagatattccataagcttgtttaaaacatttgctaaaataatgcgcatcattgaatcctgtcatataagctatttctgaaatattgtactctttactttctattaattgtacagctcgcttcattttcatttgttttaagaagtcaataggagattgtcctgttatacttttcaattttctgaaaaaattagaacgactcatatctacagctaaagccatgttatctacagaaaaatcacaattgtccatattttctgttattatttggacaagtttatccataaatttttgatccgatgcggatagtataggtatattttctttttcgacagattttttttctgcctttgaaggaaacaatgtttgacaatagatatgttgtaaacgtttacgttgttctactatattttgtattctggcttttaagtatgtagcgctaaaaggtttagtaatataatcatctgcgccatactgcataccctctattttactttcaatagatgatttggcacttagcaatataataggaatatgactggttgactcattattctttagctcatttaataactctattccatttttgtgaggcatcataatatcactaatgataatgtctggtagttgttcataagcaattcttataccagtttctccattatcagcttctactatattataagattctgttaatattgttttaagaaaactacggagttcgttattatcttctactagtaagattaagttcttgttatcttctattttctgttctggcttatcggaaattgttatggcagtatcattatgcgttgagtttatcgttttattcacaatatcttcagatacgatgaattcagtattagagtcaaaatgactattacctttttgtaaagtgacagtgaaacaacttccttcgttaggttgactttctacagtaatggttccatgatgcatttctacaagttctttggttaatgacaaccctattcctgtactctcttgagtatgtatatgctgatcggagaagttttcaaaacggacaaataaacgttttaattggtttttagtcataccaacaccttgatctataatacttatagatatgattttttcattttctgtaatttctattgttatattctttcctttgggggtgtatttaaaagcatttgatattaagttgaaaattattttttctaatttgtcggtatcggcccataagatgactgggtattcaggagctttaaaggataaattaatatgttgttcgtttgctagataattgaaattttctatgatttgacgtacaaagggaagaagatcgatttgctgtacgtgcattttcatttttttattttgtatttttctgaagtcaagaatttggtttactaagcgaagcattcgattagcattccgttctatgatgaatagttgttcacgtacttttccctctatagttttattatttaataattgttctaccgggcccgttatgagagtaagaggggtacggagttcatgagaaatatttgtaaaaaaacgtagttttatatctgatatctcttgttccatggaaactttgtgttttagtcggtaaatgacaaataaaatgtaggaagtaataaatattattgctaagatagtcagtgcatacaatagataagccaatggtgtttcccaaaatgaaggtaaaatagtaatgtttaagtttcgtacattatctacccatattccatcactgtttgtagaacgtactttcagaatataatgacctttaggaagattggtataatttgcagaacgttcttttcctatataattccagttcgtttcgaatccttctaatttgtaggcgtaaaacaggttatcatgatttttcatatcaagtgcagcaaactggatgttgaatgtattctgataatgcggtaatgttatttgagatacgtcatctatatttttatgaatcaggctactatcagatggtgttatgattttttcacctgattgcaattgtgtaaacacaataggaggaatgtatttactgttttgaatagaatcgggatgaaagtagagtgcgcctttaaaagtgttgaataataagtagccgctttgggtatgtagtgcttctccttcattaaacttaaaatgcgtgggaagatcccatgatgaataagttattacttctttagtaaaagggttaaatttgcatagttcttcttctgtagctaaccacaagttgcctttggtgtcttctactatagataaaataacattggcaggcaaatgattttgagtggtataagcttgaaaaagtaggtttccgtttttcccttttaaaactttattcaaacctcctccaaaagtagcaagataaatatttccatttatcttgctaaataatatttggtgtatgttatcattactaagactatttttatttgtatcatcgtatgtataatgactgaaggttatatcttctgcatgagtagaagttacatttgttattaatagtccattagttgtgcctatccatatattgcctatagtatctgttgtaacgtatcgcgcacgattacagagatttattggatagttttttaaagagttagccgaatgatagaatgtattgttatctatatttagatttacataattcacccctcctccaaaagttgctatccacatgcgtttgtatttgtcctcacacatactatatatattattgtcactcaggctatacatatcatccgttcgatgcatgtaatgagttagtgtatatttatatttttgtagaggagttgctataattattccatttccttttgttcctatccaaatgcgtcctttatggtcttcagtaaagcaatatgctgttccaattttatcttttttataaagagatatagaaccattttgggtaagaaatcctttaaaatgtaagttcttatcatatatacgtattgtctggtcctttatacccatccatatattcccttgagaatcttggaaatttgcacgtgtataattttcaagtgattcgttatctgatgaaagattttggtataaatgaaatggattggtattaaatgtaactttttctaatccattattataagaaccaaaccaaagattaccttgtttatcagagaatattgctgtaactttgttctccgaatcccatcctgattgacgttctgtattgaagaaaggttttagagtgttagttttcctttcataatatcctaaccctcctcctgaaggatgtatccatatattatggtttatgtcttcacatacgtacatttcaggccgagagttgactatttgcttattatgtctatctttgagagtaaaatgttttaattgtggagctggattgaaggatagatgagttactcctaatgtattttctaaacgtatccaggcttcattttgactgtctataaaaacatcttttacataattatttttaagttctttatttgtttgagtcgtaaagtgtgcagacgttccttgtggaatgtcgtaaataagtattccgttatcttttgttccgagaaataatttgtttggaccaatactgcgtataatgttgatatcacttcttgtggcagcatgaaataatgtaaattgcttcctctttttattatattgccaaatacttcctttgcttccagaaaaataaatatcagaatctgtttctatcacatcataaacagagttgggtaatttgtaataatgaattttatatagagacgtattgttaaatataactttatagatacccgcttgtgaaagaatccatacattgttttcatcatcctctagtaaattatacactttgtttttagataaatgatttttctcgaaaaaattgtgagtaaataatgtttttctgtcagtagagttataagtttcaataagatcgcctgcattggttataatccatgtacgtccatagtgtaatggatgaattgacttggcttgataattagagtatggaagtgataaaaaggtttcattttccatatcaaagcgatatacttgtaaatcataactgatcatccaaagataagagttttctccttctactaaataatctattcggctattattaaatccactgttattaccttttttatttttataatttttgaaatgataaccgtcaaatttgtagatgccatcccatgtagcaaaccaaataaaacccttgttgtcttgtaaaatgtgcatgatcgttttttggtatagcccgtctgatgttttatattgcgtaaaagtatgaggaggttgtgcacttatgtttagaagtgaacaacatactgaaactaaaaaataaataaatcttatgtttttcatgtgtctttaagtgttgtgtcctttaaaaagtttgctggtcattgcaaaaatataaatttttaattttaagtgtaaagatgattgttgattgttgatagtttattctttatatttttaaattatagaattatcgctttctattgggatatgtataataaatgaggaatataacttttatcctctgactaaaatttatcctctgactaaaatttgtgattttctgaaatatttaattacagaaagaacatcatcataagttgtattggataataatataaaaaattactctttttaactcttcacagccttcactaatgtatagcaatcttgtcataggtaacaagactggtaattttttagtgatagataaatgattgtgtgaagggcgtggagggcaaaaacaggtgtttttctttttaaaaggtgcctgaactggtagaaacagcccttcacggtccagttgaggtgtgcttgtttttattcttttactcggatttcgtaatagtttccggcagaggagggggctttttaccctttttcgcataaaatttcatcatttttctgtttcggaccgtactattacgcggtgtctcggaaaattttctttcatatttccttcggtttttcccgctgctgtcttatgtttttgtacaaaactttcaggaatttgtacaaaacaaaatattttttgtacaaaaaccggagaaaattccggcatgttttttcagcattttcgggatctttttatgcggattgcggatttttttgcttttttctcttgacttttccggtggaaaaatccgtttttttaacccgaccgtccgtcaatgacagaatttattcctatcggccgtatatttttcatgcttttttcgtatgattcgataaatttttcagcttcttttcccgtgtttttctgcatttttccgcccgcctgcgaaaaaaacggttgcttttttcatccggattatccgttttttgagacttttttcgcttcgtcggaataatttttccggcctttttccatgcgaaactgagaaattttccatttcgtccccgtatttttatgcttctcctgaattttttcaaaagaaaaatccgctttttggggtttccatcacccaatttcggacatgtttttcctgacaatccggatatttttcaagttttttcgtgggaaactgagaaatttttctgcccgtttcgatattttttgcgcttctcctgaattttttcaaaagaaaaatccgcttttttcagcatgaatttcccttgcggatgatccatttttcccttcctcggggagtatttccggatttttttcgtgtcatccgataaagaattccatccttccagaggtattttccgctccatccggcaggaattttcaccgttccggatctttttcgcacgaaccagactcgcgcgcacctgcacgcgcgtaataatatattgagtacccctcccggctccctttcccttattccggaaaacctgccgtaaaacatacctgaaacacagcattttatgaattttcttgcaaaaaaaattgaaaaaaagtgtgggtaaaagttggagaaagcgaaaaagtgcgtaattttgcacccgctttcgagagggaaagacgttgaagagatgacaatctgaaaggaaacggagcaggaagcagcggttctgaggcggtccaagtatcttaccttaacggcgttaagggagcgagaacggcagccggacggagtcaacttccgccgctaaaaaaactttttgaaaaaaactttcgaaaaagtttggcggtttcgaaaaaagctcctaactttgcaaacgctttcgacaacgaacggaagccacaaaaaaaggaaatagttctttgaaagactttagataaacaaacgaagatgtagtacaagaagtagctgtcatatataataatgtatatgcggtgaaaaagaaagaaccgtcaatatttgaacaaagtaaagacattcggttacctgaacagagacaaaagtactcgcaagagtaaaaagatattttacaatgaagagtttgatcctggctcaggatgaacgctagctacaggcttaacacatgcaagtcgaggggcagcatgaacttagcttgctaagtttgatggcgaccggcgcacgggtgagtaacacgtatccaacctcccgcttactcaggaatagcctttcgaaagaaagattaatgcctgatggtatcttaagcacacatgtaattaagattaaagatttatcggtaagcgatggggatgcgttccattaggtagtaggcggggtaacggcccacctagccgacgatggataggggttctgagaggaaggtcccccacattggaactgagacacggtccaaactcctacgggaggcagcagtgaggaatattggtcaatgggcgcgagcctgaaccagccaagtagcgtgaaggatgaaggtcctatggattgtaaacttcttttatacgggaataaagtggtccacgtgtgggcctttgcatgtaccgtatgaataagcatcggctaactccgtgccagcagccgcggtaatacggaggatgcgagcgttatccggatttattgggtttaaagggagcgcagacgggggattaagtcagttgtgaaagtttgcggctcaaccgtaaaattgcagttgatactggttcccttgagtgcagttgaggcaggcggaattcgtggtgtagcggtgaaatgcatagatatcacgaagaaccccgattgcgaaggcagcctgctaagctgtaactgacgttgaggctcgaaagtgtgggtatcaaacaggattagataccctggtagtccacacggtaaacgatggatactcgctgttggcgatatactgtcagcggccaagcgaaagcattaagtatcccacctggggagtacgccggcaacggtgaaactcaaaggaattgacgggggcccgcacaagcggaggaacatgtggtttaattcgatgatacgcgaggaaccttacccgggcttaaattgcagacgaattacttggaaacaggtaagccgcaaggcgtctgtgaaggtgctgcatggttgtcgtcagctcgtgccgtgaggtgtcggcttaagtgccataacgagcgcaaccctcgtggccagttactagcaggtaacgctgaggactctggccagactgccatcgtaagatgcgaggaaggtggggatgacgtcaaatcagcacggcccttacgtccggggctacacacgtgttacaatgggaggtacagaaggcagctacccggcgacgggatgccaatctccaaagcctctctcagttcggactggagtctgcaacccgactccacgaagctggattcgctagtaatcgcgcatcagccacggcgcggtgaatacgttcccgggccttgtacacaccgcccgtcaagccatgaaagccgggagtacctgaagtgcgtaaccgcaaggagcgccctagggtaaaaccggtaattggggctaagtcgtaacaaggtagccgtaccggaaggtgcggctggaacacctcctttctggagcgtgaccgagtgaaggtcctttcggtcttgtgctgcatgcgagtttgtttaacgaaataaagagagaaagatgaagccgagtcaggaaacagacgaggttgaactgaatcacgcaagctagtcctatagctcagttggttagagcgctacactgataatgtagaggtcggcagttcaactctgcctgggactacctcgaggaaagggagcgaagaaaaaacttccttaaaaatttgctcaagcgaaagtaaatgcttacctttgcagccgcaaaaaaacgggggattagctcagctggctagagcacctgctttgcacgcagggggtcaacggttcgaatccgttattctccactatagaaaaataggtctatgacatgatgtaacaagcaaaaagtaattttagtacgaaagctaaaagtatatatcatcccgcactgttgaaaaatggtgtgaacgataaggaaagtaaagaagggcgcatggcggatgccttggctctcggaggcgatgaaggacgtgataagctgcgataagtcacggggaggtgcaaataacccctgatccgtgaatctccgaatgggacaacccaataccttgaagaggtattaccttacacagtaaggggctaacgcagggaactgaaacatcttagtacctgcaggaaaagaaaataacaatgattcccccagtagtggcgagcgaacggggaagagcctaaaccaccggtgttacggcacaggtggggttgtaggaccgcgtcgttgcaagaaatcttgcgagaagaacgatctggaaagttcggccgaagacggtgacagcccggtattcgaagcaagacgaagcatagcggtatcctgagtagcgcggaacacgaggaattctgcgtgaatctgccgggaccatccggcaaggctaaatactcccgagagaccgatagtggaccagtaccgtgagggaaaggtgaaaagcacttcgaacagaagagtgaaatagtacctgaaaccgtgcgcctacaagcggtcggagctcctaacggagtgacggcgtgccttttgcataatgaacctacgagttgccgtcgttggcaaggttaagggacacgagtcccgcagccgaagcgaaagcgagtctgaacagggcgtcgagtcagcggcggcagacgcgaaaccaagtgatctacccttggccaggatgaagtctgggtaacaccagatggaggtccgcaccaataagcgttgaaaagcttctggatgagctgagggtaggggtgaaaggctaatcaaacttggagatagctcgtactccccgaaatgcatttaggtgcagcctcgtggattactgatgtgaggtagagcgactgattggatgcgagggcttcaccgcctatcaagtcctgacaaactccgaatgcgcatcagttttaccccgggagtgagggcatgggtgctaaggtccgtgcccgagaggagaagaatccggaccaccggctaaggtcccgaaatgacagctaagttaaactaacgaagtctgattgctaagacagctaggatgttggcttggaagcagccattcatttaaagagtgcgtaacagctcactagtcgaggaatcgggcatggataataatcgggtataagttgtctaccgaagccgtggaaccagcaatggttggtaggggagcattccattcggcgtcgaaggcgtaccgcgaggtactctggagcgtatggaaaagcaaatgtaggtataagtaacgataaagggggtgagaaaccccctcgccgaaagactaaggtttcctgatcaacgctaatcggatcagggtcagtcgggtcctaaggctcagccgaacggcgaggccgatggcagaaacggttaatattccgttactaccttggagggtgacgtggagaagcagaagtgacactgccgcgggctgacggaatagcccgttaaagagtgtaggtgctgattcccgcaggcaaatccgcgggaagagccgaacttgacagtatggagcgtcctccgggacaatccaacagcgcaggtaagcagactgccgagaaaatccgctaaacataacttccatggtacccgtaccgcaaacggacacacgtagtcgggttgaatatactaaggcgcttgagtgaatcacggttaaggaactaggcaaactgaccctgtaacttcgggataaagggtccctcctcgcaagagagggcgcagagaataggtccaggcaactgtttaacaaaaacacagggctgtgcgaatatgaaagtagaagtatacagcctgacacctgcccggtgctggaaggttaagaggagatgtcatcgcaagagaagcattgaattgaagccccagtaaacggcggccgtaactataacggtcctaaggtagcgaaattccttgtcgggtaagttccgacctgcacgaatggtgtaatgatccggacgctgtctcaaccgtgagctcagtgaaattgtagtatcggtgaagatgccgattacccgcgatgggacgaaaagaccccgtgaacctttactatagcttagcattgaatttgggcacgcgatgtgtaggataggtcggaggcaatgaagcaggcacgccagtgtttgtggagccgctgttgaaatacgaccctttgtttgtttgaattctaactcccggatggaggacattgcttggtgggtagtttgactggggtggtcgcctccaaaagcgtaacggaggcttctaaaggtgccctcaggacgatcggtaaccgtccgcagagtgtaatggcaaaagggcgcttgactgggagacagacaggtcgagcaggtaggaaactagagcatagtgatccggtgtttccgtatggaagggacatcgctcaaaggataaaaggtactccggggataacaggctgatccctcccaagagctcatatcgacggagtggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgtatgaaatttgcgtggctctgacactagtacgagaggaccgtgttggaccgacctctggtttaccggttgtgccgccaggtgcatcgccgggtatctaagtcgggatcggataagtgctgaaagcatctaagtacgaagccggccacaagattagatttctcagggtcgtcaaagacgatgacgttgataggatgcaggtgtaaaggtggagacaccaaagccgagcattactaattgcccgttcactttccttgaaataaggatggatgatatatactttcagctttgaaacaagtgctggaattgcttgcttgtgagtcatgaatacataaaacgatattcaggtgactatggcacgaaggttccacctcttcccattccgaacagagaagttaagcttcgtcacgccgatggtactgcgcaagtgggagagtaggtagtcgccgtcttgaagaggtcctgcagcaacgacgctgcgggacctttttttatgcccggacgcgacgggctgacgcagggacatactcgattaaacaatctgatagaatttgtttcttggaattttttgtgcctgcttgtatacgacaggacgctccgagagcgggagttctttattcgggattagcgtgagaatacggatttatgtaaaaacttaaaatgtaacttgtcatacagaatctgttttcctaagtttgaattttatagggataaaaaagatctgtacagaggacagaaatcttcttatagcgaaaatcaatgcttctttgagttgatttgacatgaatattccatccattctttaataatgattagttttagcgcgttataaggcgatatttcgaacgaaatgtcttgaactttataagtttccttttaaagaataaaacgggaaatagcgggaaataattggtgtgattatttatataaagtctgattaaatgaaataagcccgatgtaaaccgggcttatttcagatattaataaaggttcgttttgtttattgttcaccttcttttcgggctgcatgaggataatcgatggtatagtgtaagccacgactttccttacgttccatagcctgacgagtaatcagataacctacattaatcatgttacgcagctcgcaaatttctcgtgaagcttttacgcgtttaaagagacgttctgtttcttcgtataaaatatccagacgattccatgcacgtactaagcgtaaattgcttcgtacgatacctacataggcctccataatctgatttacttccttcatgctttgagttatcaggatgcgctcttcattgctgatagtaccttctgcattccattcaggaatatcttcattgaaatcatagcggtcgaggacgcttagagcgtgtttagctgctgaatcggcatatacgatagcttcaataagtgaattggatgccagtcggtttccaccatgcaatccggtacaagaacattcaccgatagcatataggcgtttgatgctggattgtccatccaaatctacttttataccaccgcataagtaatgggcagcaggagctactggaatatagtcttttgtgatatcaatgcccaagctaaggcatttcttgtaaatattcgggaagtgctttttcgtttcttcgggatctttatgtgttacatccagatagacatgatcttcacctctttgtttcatttcgttatcgatggcacgagctacgatatcacgaggagcaagagataaacgtggatcatatttctgcatgaattcttcgcctcccaggtttcttaatacagctccatagccgcgcattgcttctgttatcaggaaactgggacgatctcccggatgatataaggccgtagggtggaactgaataaattccatatcttttacaacaccttttgcacggtaaaccatggcgataccatcgcctgtagcgactaatggattggtggtatgagtatagactgcttcacaaccgccggtagccattactgttactttcgacaagaatgtatctacttctcctgtactttcattcaatacataagcgccataacatttgatacctggagtgtggcgggtaactatgataccgagatggtgttgagtaatgatttctacagcatagaaattagtaaataccgtgatattaggatgttgttttaccgcttctatcaagctggtttgaatttcagctccggtattgtctttgtgatgaagaatacgaaattcggagtgtcctccttccttgtgcaggtcgaattctccgttttcattcttatcgaattttacgccccattttattaattcttcaatttgggcaggagcattacgtactactttttctactgctgccggatcactaatccagtcgccggccaccattgtgtcgtggatatgtttttcgaaattatccaccttcagattcgttacggaagcaattcctccttgtgcatagtaggtattggcttcctccagtccggctttgcagatcagtgcaaccgaacctttatgcgctacttttagcgcaaagctcattccggcaattcctgaaccgataacgagaaaatcgaattttcttaccataacaacatgtataatactattgcaaaactacaaaaaaactagtatggccgtgtcgtatctttgttttttttctaaagaacctttaatatgtatcgtattcggcgataaattgctatcttcacccaataattaataaatcttacagatacaatggatagaacatttcattctaaggtagactggtggtattggttgctgatggctgttacggcttttttgctgtttgattttttctggtttcattatacgatagcaacgatattggttgcagttgtcatgatatttgaaattgaaatgttgattcatactcgttatattgtgacggataatggtaagttgcaaattgagacaggacgttttgttgctgataaaacgatattattgaatgatataaaggatttgcggaaaataaaatctttctcagttgctcctgctttatctgtcgatcggatcgaaattgtatatcataataacgacaaagtggaaaaaatatgtatttctcctcaaaatgccagtgaatttcttcgctggatagagaaaaaaaggaagattgaagaataaacatagtgagctactaaaatttatgctttatggaaaaattcaaacctagaaaatcggtaaaaagatttgtttgtgaaacgttggtaagtacacttataagttcgctcattttgactctgatcgttgttttttataatcaggaaaatttaggtatatcagtagtggtacttatacttttttttattctggatgtacttttctccatgtatggagaagtaaaggagtatcagatagatgaaaaaggaataatcaggattgtttgttatctgggattctctaaggctatgataaaagacgtaacccaagtgttttttgatcctcaacgtaaggcattgcgtattatttcaaaaaaaggagatcgatggtgtcctatgaaggaaccggaactatttgtggatgctttatatgaatattatcccaaaatgaagtacgaagttttgagataatttctgaatatgtaaaacctatttaaatctaaataatatgataaaataccaagttgcaatcattggtggaggacctgctgggtatacggctgctgaagtcgcaggaaaagcaggattgagtgtggtgctgtttgaaaagaacagtttaggaggagtttgtctgaatgaagggtgtatacctactaaaacgttactatattctgcaaaagtatacgactacggccgtcatgcttcgaaatatggagtaaacgtttcagagtcatcgttcgatttaccgaagattatttcacgaaaagcgaaagttgtccgtaaacttgtgttaggtatcaaggctaaattgatggctcagcaagtaacgatcatcagcggggaagcttatattgtcgataaaaataccattcgctgtgcagatgaaacataccaatgtgagcatctgattatttgtactggtagtcagacggttattcctcccatacaaggtattgaaaaagtggagtattggacacatcgtgatgcactcgacaataaagaattacctcactcgcttgcaattgttggaggaggagttatcggaatggagtttgcttctttcttttctagcttgggcgtacaggtaacagttgttgaaatgatgaacgaaatactgaacggcatcgaccgtgaactagccgctgctttacgggcagaatatgccaagcgaggtgtgaaattcttgcttggtgccaaagttacaggtctttcgcaggatgaagaaggcatacatgtatgttatcaaaatgcagagggggcgggcagtgtatgcgccgataaattattgatgagcgtcggtcgtcgtccggttacggaaggattcggactcgaaaatctgaatttggagcggaatgaacgtaaaaatatctgtgtagacgcttatttacgtacatctgttcccggtgtatatgtatgtggtgacctgaacggagtttctttgctagcacatactgccgttagagaagccgagatagccgtaaaagatattttgggtgaatcggaagaaatgagctaccaagctatacctggagttgtctatacgaatccggaagttgcttctgttggtaagacagaagaaaatctacagtcggaaggcattgcctatcgtgttgtaaagctacccatggcttactctggcaggtttgttgccgaaaatgaaggtacaaacggaatacttaaggtgctggtagacgatgctgatacggtgctgggcgtacacatattgggaaatccagcttccgaactgatagtcttaggcggtatgatggtagaggtacatcgtaagttagcttatttcaaacgttttgtctttccacatcctacagtgagtgaaatcttcagagaattgtaatgtatgaaacgaatcggactgctatttatctcttttattgtatgctgcacgctggtggcgcagacacttgccgaccggctggatgcattggtttcttcggataagttattgactacgtcggaggttggtattagtgtttttaacctaacccagggaaaacaggtttatgcttatcaggataagaaactttatcgtccagcctccattgaaaaactgatcacctcggttacggctttggcggaattaggtgaatattatgttttcaacacaagggtagcatatacaggtacaatcacgcaagatagtgtactgcaaggagatttgtatgtagtcggtgggtttgatccggagtttatggacgaggatatgaacaaactggcagaagctgttcataactccggaatccgatctattcaaggccgtctggttgccgatgtatcattgaccgattctatttattgggggcccggatggtcgtgggatgatacacccgaatctttccagccttatctttctccgcttatgctgaatcgaggatgtgtgaatgtaacggttattccaggtacaaaaggaaaacgtccgcaagtagaggttgtacccgaatcggattattatactgtttgcaatcttgccaaaagctatctgccacaagaaggaaagctgaaggttacccgtaactggctggataacggcaatacgatttatatcagtggaaatgcaaattatcgatgtaccaagaagctgaacatgtatgcttcgcaagatttctttttgcatacgtttgcctataaactgaataaaaaaagaattaccgtacaagctgttgcctatggaatgtgccctgatgaagcaacaggactctatactttgtcacgtccacttactcctgtgctgaaacgagctctgaagaaaagtgataacttgtctgccgaagctctgttttatcatctgggcatccatcattcggatgaaaagtatgtaggatacaaggacgcacaagatgtcatttacgattttatgaaaaatgagatcgggtataatcctgatgattatagcattgtagacggtagtggcgtatcactttataactatatatctccagcactgatgatagaatacctgaagtatgcttattcacgtgccgaaatattccgccctttatatgaagctcttccgatagctggtgtcgatggaaccttgggaaaccgtatgactagtcctaaataaccgttacagttattggacaaaaataaattatttatcacagttcagcaaggtcagtcttgctgaactgtttgtttttgtaacttttaattttaatcagcttctgatgatgcatatactccggcgttttatacccacaagagtaatgaggtctgatgttattatacttgtagacagcatcccttattacctgtttcatatctgatagcggtagattaagttcctcaagcaggaactcctgttttagtattccgtttattcgttctgccacggcattagcgtacggatcgtaagattcagtcatgctgggtatgatgtgatattgtcccagtaatttctgatatgcatcggaacagtactgtataccacggtcagagtggtgtatcaatggcgtgtccctatacagtcggttgcggtttgccatcctcagcgcgttcaaagaaccttgagtgtccaaggaatcggaaagatcatatcccataatcttcttggaataagcatctgtaaccagagaaagatacatatgccggtttctattgccaatataagtaatatcagaaacccatatttcttccgggcgtgtcgcttccatactttctacaagattcttgtgcttccgaaaccggtgatgcgagttggttgttacatgatatgaacgtacgggctttataagcagacggttggcacggagtatatcgaacagtttgtccctgcctaccttgttctccttaagtggctgatgaagcatatgataaagtttgcgggttcctacacgtggcagttccattcggatatctcgtaccatgcccacaacatcagtggccctttgccggcctcggattatcttccattgctgacggtaatatttctgcctgcttatcccgagcagtcggcagattccgctgatacttacggatttttcttctttatatttattgactgttcgggagaggagttttttcgtatgtcgatattatattccttttccgctatgtctatcatcatgtcgaaaaactctgctttcatatccttcagctcaagctccttttccagacgggcattcttgcgttccaggaaccttactttctgttgtagttctaacagtttttgatccttactcttttccatagaatggtaacatttgtttgtgatatcaaagttaccatatttttcaatccaacggctaatagttgaacatccttgtatcccatattttcgtttcagcgctcccaaacttatttttgtggtttcatactcttgcactactgatagtttaaaggacatactgtaatctttttgtgtgcgcttaacgtactttgtttctgtcttttccataatgttaccttttttgttgtaacgctatttcaggactagacagtatgaaaaaaggaagggcatatcgcaatgttcatgctaaaacaggaacggtaacgggagtcagttcgcttgctggatatgtaaaggctggaaatggagatatgcttgctttcgttattatcaatcagaatgtcttaaagggtaaggatgcccgtctttttcaagataagatttgcgaaatattaatacactaataaaaagaaattagtatatttgtgacgtgaggaattaaaataaataattccgtgttcgcaaacggaaaagcattttgcttttttatgctgatattagttattaacaatataaacactaaagaaaactatggttaatttttcacttgaaggaaaagtagctcttgtaacaggagcttcttatggtatcggttttgctatagcaaccggttttgcacaagctggtgcaaaaattgtattcaatgacattaagcaggaactagtagataagggtcttgctgcttataaagaactcggaattgatgcccgtggttatgtatgcgatgttaccgatgaaaaagcagtaaatgcactggttgcacagattgaaaaggaagtgggtgtgattgatattttggtaaacaatgccggtattatcaaacgtattccgatgtgtgaaatgtcagcagccgaattccgtcaagtgattgatgtcgatttgaatgctcctttcatcgtatcgaaagcagttattccaagcatgattaagaaaggtcacggaaagattatcaatatctgttcaatgatgagtgaacttggtcgtgaaacagtatcagcttatgcagcagccaagggtggtttgaagatgcttacccgtaacattgcatccgaatatggtgaattcaacattcagtgtaatggtatcggtccgggttatatcgctactcctcagacagctcctttgcgtgagcgtcagcccgacggttcccgtcatccgttcgatgctttcattgttgccaagactcctgctgcacgttggggaaatccggaagacctgatgggaccagctattttccttgcttcggatgcttcaaacttcgtaaacggtcatgtgctttacgtagatggtggtatcttggcttatatcggaaagcagcctaaataatttttatccctcccgaaagaagtaaaaagacctgcagatgcttcaactgaaacgtcttcaggtctttttgtttttttgtataagtaaaaactttttaggatattacgaaatagggttattgaggttgattgttgtagaataatttttgttgcaaaataagatattactttagtttcgtaataactatctgataaataatgacttattattatatcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgattatattatataaatatattattggttttatattgttagaaataactctattagaatcttattatagactttaatgataaaactaaattgttttatatctgtttctgatacatttgcaagtgatcgatatacgggaaagaagccacccgaatattgtggaataataaagttacattaaatgttatcagggctgatcaaacctttttattatgaaaaacaagtaagtagatcaattaaacttttgtgttatattaacctaaaaacatagtatgaaaaaacaatttattactattcttttctatttatccttttttgtcttaagtgttggtgcaacagatacatggacaatctctacttcttcaaaagaaaattataacggcattactttaggaaacggtagaattggtttggtaagtagttctcaattatttacagtgaccgatattgtgatgaatggcgtttatgataaagagaatagagaaggagttagtcgtattgtacgtggtccattatttacgaatttgcttttaagcattgatggtacgcaaattaccgataaaaatattagttcttggactcaaacattagatatgagaagagctaatttgcagacacaagttcaaacagataaagctgagatttcatatacacttagagcccttagaaactttccatacatgggaatgattgttgtagagatgttacctaaaacagattgtatgctagaagtgacaaattctactgtatttccaggtgaacttcaagaaacttctgctacctacaagatgttaaaagatggaaagatagagcttccagtatatacttcacaagcgaaaagtttaacaggcatgcaagaccttgcaacgtgttcagcttttttgtttgacgaagaaagaccacttatatatgcttcatatacagcttcgaatcaacaagctatgagtttcaatgttcaattgcagaagggaaaatcatatcgttttgcattaattggttctgtctgttcttcacgtgattttgtaaatccgaagaatgaagctgaacgtatggctgtttttgctttgcaatcggatatagattattttattgaagggcatgaaaaagagtggaatagactatggcagagcgatataattatcgagggagatgatgaaacacaacgtgatgttcggttggcattatataatttgtattctttcgctggagaaaatacacgtttgagtattccgccaatgggattgtctactgtaactggttataatggtcatgttttttgggatacagagttgtggatgtatcctcctttgttaatgtttaatacccaaatggctcgctcgtgtgtcgactatcgatatgacagattggataaagcaattcagagagctaccttatatggatacaatggttgtatgtttccatgggaatcggatgattctggagaagaagccactcctacatggtgtttgactggtacatttgaacaccatattacagcagatgttggcattgcattttggaattattatcgtgtaacaaaagatataaattggttgcgtaaagaaggttttaaggtattaaaaaatatagcagatttttggacttcgcgttctgttaagaattcagatggcagttattctattaataatgtggtaggtgccaatgaatttgctccaaatgtcgacgataatgcttttacgaatggttctgcaaaagttgctttagagtgtgccgtaaaagctgctaaaatattaggagaaaaatatgatcctcaatgggagatcgtagccaaaaacttaactttccattatatggatgatggagtaatgaaagaaaataaaacttataatggtgaaattataaagcaagctgatgttaatttattaagttatcctttaggtattatttcagataataagagtatgcgtttaaatttggattattacgctcctaagatttatgaggatggaccggctatgggtaatgctatttgggctattctttctgcaaaactgggagataaggaaactgcatataaatattttaaagcaagctatttgcccaataaacgtcctccatttggagtactttcagaatcagcattttctaataatccttatttctgtacaggtgcaggtgggttattgcaggttgtcttgtttggatttggtggccttgagataacggataatggcattatccaaaaaaatccaatattaccatctgaatggaagtcgcttactttaaaaggaataggtcctgataaaaaaagttttgtgataaaataaagttatttttttgataaccctttgtttaaatcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgttaaataaatatattatgaaaaagatattaatcagtgtttcattgtttttgtgcgcagcagttcctatatctgcagcttttggacataaaaaggcaacttctattgatattgagaaggtgtctcaagaacaacgtaaggtttccgttgttgtgaatgataaaaatggtcctgtgataggtgctaatgttttagttaaaggaactaccattggaaatatcaccgatttggatggaaaagctgttattgagggtgttcctcaaaatgcagttttagtaatttcatttattggatatttgactcaagaaatacctttaaataataatcagaaaaatattgaagttacattagttgaagatactcagactctttcagaagtaatggtcgttgggtatggctctgtaaaaaaatcagatgccacaggagccatcgatgttattaaaagtacagattttaataaaggggttgtatcttctccagagtccttatttaagggacatattgctggtgtgcaagtaactccaacaagtggtcagcctggagctaattctaatgtgcgtatccgtggtgtcaattctatttcagcttcgagtgaacctctttatgtaattgatggtgtacctattgacaattccagatcaacgactaatgtaggaggggattcaggtttaaatagcttgtcaatcaatcccttatccatgatttcagcttctgatatagaatcgatgactgttttgaaggatgcttcggctacagctatttacggatcacgtggtgcaaacggagtcattataataactactaaaggtggtaaagatggtgttcgttctttaagttattctggttctgttggattctcacaggtatctaataaaattagtgtgttgtctgctgatgaatatcgtcagtacgttcctaatgcaacaggtacagcttcaacagattggcaggatgaaattttcagaacagcatttgttgaagaacataatattaacgtgagttcgaaataaattaaaacatcgtgagttgtccgtctttgacaaaacaaacgtcaatggcgggcttcttttcaaagaagcagtatgcagctatggcagagagcgagttggcaataaagttattgaaggaacggtgtctggagtgttcaatctgggcgatgttctttaactcgtcattgactgtttcaatcaaagcacgttttctcagcaggattttgtccgccacgttcatcagggagttcttcatgttgttcttcactttggttatcaactgtatgccgttaaggaacaggttctcgaacagggtttgcccgacataccccttgtccgcacagagtttcccttttatattcttcaggaactttgtctgtttcagcggttcacggtcatccacatttcccggagtgaacatgaaattgaggatttcacccttatcgttgatgatcaggtgaagcttaaacccgaagaaccatcccatggagcattttccacgttcggcgagacccttaaaagtcttgtgaatcaatatgcgttggttccggcatacacgcagcggggtggaatccacaaagctgataccggtgcaggtacccaacaggacttccttgatgaaaatggtcagctgcaacaggacttccttttccagttccacaaaacggttataggacacacgtctgggaaagagatgcgtcagatgtttgcatacatattctttgtagtaatgcttgaaacatctgaagcctcccgagtggaacaggatcaagatgaccatgatttccgcatcactcatccggttcggcttgttccgatgcttatgattcttttcttcaaccatatatttttcctgtgttttggcaaattccttgcaaaaatcatccgccatacaaaaaatctccgtaactttagactctgagaacatagtggtaatcgcttaaatgttatacttagacactataaatttaatgcttttatcgctatgttcctaattttcaaactgataattttaatctttatatcgaactcacgttaatattacattcagtaatggtaataaaaatacatcttatcgtgcttcgttaaatttttcagatcaaaatggtattgttataggaacgggtatggatcgttactctttacattttaatttgacgcataagatgtttgatgatcggttgatttttaatttgaatgcgaataacacttattatacattagataacgttttggagcaacaaacaggaggttctaatggtggtattattaataacgcattgaaagctaatccaacagaacctgtatataatgaagatggatcttttaatgaatatgcagaatctgtacgtaatcctgtagctatggcaaagcagatgtatgataaatcgagaggagatcgctttatcggtagtgcagacgccacctatttctttattcctaagacattgtctggtaagattaatgtagggtacgatgttgataatatcaatcgtaaagcttatcaaccaattgattcaaaggctgctgagaatgttgaaggacgtgctattaccgaaagtaaccgctattctaactatttgtttgaaggttatcttacattcgataaaacatttaatgatatccatgcattgaatgttgttgctggttattcatggcaggaatttgataattatacttcaacggttcgggctgaaggctttgtaaatgataatttaggagctgacaatgttggtggcgcacgaactcagcaagcacagaataatgaagagttaaatcggttgatttcattttatgctcgtgctaattataatttgatggataagtacatgtttacagctacggtacgtcgggatggttcttcacgctttggtgttaataaccgatgggctactttcccttctggagcatttgcatggaaaatcaaacaggaagagttcttgaaaaatgtatctgctattagcgatttgaaacttcgtcttggttatggtgttactggtaatcaggatattggtaacttccgttatagtcagacctattcgatagatagtaagcaaggaacttcttttggtggagttgcttatcctgcatataatattactggtatcgccaatccagatctgaaatgggagcagacagcacaatttaatgttggtttagattatggcttcttgaataatcgtatcagaggttcttttgatgtgtatcataagaaaacatcaaacctgctattgactattgatgctattcagccggctgtaagttcttcatatttggataatgtaggcgctatggttaataagggatttgaatttacgatagatgcagctgtcattagtacaaaagatttttattgggataccaatttcaatatagcttacaataagaacgaagtaactgaactgtataacaataaagatattgtttatggagttgttagtggagccggggcatatggaaatacccaaatattacgagttggtgaatcaataggatctttctatggacaaaagttccttggaattgaaaatggaaaagaagtttttgaatcagatgagcgtactgtactgggtaatgcccttcctgatgtaattattggatttaataatacctttaaatataaaaactgggatatttctctctgtcttcgttctaatttaggagtagatgtttacaataatactcgtgctgaactggaacaaggtagtcgtttgcctggccaaaatacaaatattgaaggagctgagttttataaagctggaggaggtggtattgtttatgcttcctctcgttgggtggaaaatgcttcattcttaaaattggataatgttactcttggatataattttacacttcctaaagttattaaaaacggtcgtatatatataacggcacagaatctgtttactattacttcatataaaggttatgacccggaagtcaataatgtaagttctgataaagatgtaaaggcaataggtatcgattactgtagttatccacaggctcgtacatttactttaggtttaaatattaacttttaataattcatttggttatgcaaaaaattataatattcgcagttgctatattgacttcaatggcttcatgtacagatttggatgttgttcctaatagtaaactgacagatgaaactgtataccgtgaaaagtcagagtttttgaatggactctcaggagttaattctacattaggtatttggtcggaagttgtctttaaggcaggaacttctgccgatgatatgatattgcctgcaagaggtgctgactggaaaggcgatatacaagctgttcattctcatacttggacgcccgataatagtgaaatgggagccgtctatacaggtatatcaaaaattattgctgtttcaaattcttatatagatgcgatagacaatagtagtttttcaaatgatgcagatgttgttgttatgcgtgcagacgctcgtttcgtaagagcttttgcctatttcctgatgctggattattttggtaatgttccattggtaacaacttccgcttatgattcgcagaatcctcctaagcagaatacaagaaaagaattgtatgaatttgttgagtctgaattgaaagagattgctaatatcttaccagaaaagactgagtatggacgttatgaccgatatgctgccaagactcttttggccaagttgtatttaaatgcagaagtatatttgggaaaaggtaacgcaaaatgggaggatgtagctactttgactcaggaaataatgtcaaagtcggattatattttggaagataattttaaggatgtatttaaatgggataattataatcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtataatagtaaagagattattttttctgtaatctgtgatagccaaaatacatatcctgaaaatatcagttatttgttctctatttctgacctccgtgagaaatatggatcatttgcggctggatggggcggatcagctgcattgccttcactcatacattcgtatgatcctaatgatgtacgtttggaagcttttctgtttggtccacaagtagatgctgatggaaaccctctgatggcaacagatgatcaaggggtagaacgtcaacttaattattcagtagattttacaagcaatgatccggtgaataatgcagatcactgggatggagcacgaggcgtaaaatatctgatggatggcataggaggtacaatggttgagcgtggcttaaacaatgatatgccgattttgcgttatgcagatgttttgatgatgcgtgctgaagctcttttccgaataaatccaaatgatacagaagcacttgatttagtaaacaaggtaaggactcgtaacggacataatcctgtaccggcttttgataagttgacagaggaaaatttgcttgcagaacgtggaagagaatttgcttgggaaggctggcgaagaaatgaccagattcgtttcggaacttggggaaatgcatgggactataaggaagctagtgaagactatcgaactttattccctatccctcaggtacaaatagattctaatccaaacttaaaacagaatccaggttattaattattgttgtaccgtaactttcgtatatctttatcgaaagttacggtatttattttaaatagtagttattaatatgtataggtttataggattgttaatattggtatttgctttaagtggatgttctaaaaatttagatagtactgtagctccttggcaaaattgttttcaaggagtatccaataaagggaagactagtgataagatttatgtaacagcagggagaaaggcacaaattataggtttacagaatggaacatttccagcaataggtgagcatctcaaaggggaaatgggaggtatttggactggatcatttaaagtggcagatggttttgatatgaagttagctgatataacttccaatgatgatacaatattgcatgcacgggaaatgattgtgtttccacataaaaattgttttgattttggcgatatattaagtggagtacatgtttcatctacacaattcagctctgataaagaacctggagtggtcgtttcctatatcttgacaaataagtccaagcatgatatttcgttatctgttggttttcgactaaatgtagatcttgttcctgtatggttttccgaggaaaatggcattcataatggcaatgattatattatttgggataaagataatgagctatttactgctggcgattcattacataattggtttatggcttggaagtgtgaccataagatatcttcctatgaagtgggggaaaaatgtcaactaacaggagctactcctgctaagttttattcaatgttagatttgcatcctggtcagcaagaagaaataagatatgtcataacatcttccatgaaaaatactgaaaatgcaattgaaaggtgcaatatattactgaataattacgaaaaagaattatcagaaaagaaaaactctattgaaacattactttcaacggcggaaatagatattcctgataagaaaattcaagatgctttttattggactaagattaataacagatggctggaaactgatatcgataccattggctattttttaagtgccggagctgtggaatatccatggttgtttggatgtgataattcttatgcccttcagggacaggtacgagttggcgactggaaacttgttggatcaactttacgtctattgaataaagtatctgagcgtacaaatggaaatggacaaattattcatgaaatgtccaataatggatttgttggaaataaaggaaatacacaagaaactgctcattatataatggctgtgtgggaagcctatcgatggacaggcgatatacaattgcttcgtgatctctatcccaatgtaaagaaaggtatatcgtggctaacagaaacaatggatacaaatcataatttatatcctgaaggttatggcattatggaggtaaaaggacttaatgcagaattgattgatgttgctgtttatacacagcaagcccttgttgcagcatcaaagatggcttctttattcggagaagatagcctcgctactactttttctcttaaggctgataaactaaaagaaaaaataaatcatgatttctgggatgaacaacaatgcagttattgtgatttttatggaactgcgggaatggctttaaaagctgttgctggagcaatagatcaggcgaagctaagtccgtctggtgagaatgaagatattattcctttttatgagcaattacgtcaaaatatactctcgtacgatactacgtatagcaaaggatggttcactaataagaattgggttataaatacgccgatggaatgcggtatagctccttatgacagaggtgtacaagccttaaagcagattcgtcaatataattgtggtgaatatggaccatatctgtctgccgttgagaaaaagcaaatgatgactatttcgacgggagtacaagctgttgctgaagctaaatatagaagaatagatagctctgtagaatatctgggtatgatagcaaatactttaggattgaatatgcctggtgccataaatgaaatgatgcctgattacggatgtccatttcaggcatggactatttatggaatggcaacaggtcttatttctgggtgttttggaatagaaccatatgcagctgataaaacaattattgtagctcctcagcttcctgaaaaatggaataatatggctttacgtaaattgcatgtaggggataattatataaatttgtctgtaaagcgtaatgctaattcattgacattatcttatgattctcaaaatgatggatggaaaacagggatatatctgccgggcatgtctaaaagaaatataaatgttaatggaaaaaatttgaagttgacatctgatacgctttggacacatgaaaaaagtactatattgaaaatttctaattgatttttttacatttgcactaatccatactaaaaatatggattggtgtaaatggacataattgttttttgtattgtttttatgaattgatgcgaaatttattttccttatataaattatgtatattcttttctattctgctgacttcctgtacgcagcagaataagacgattcgtatcggtttttcacaatgtactggtggtgaatggcgtgaacagcttaatcaagaaatactttcggaagctaaattttatgataatcttaaggttgatataaagaatgcttcaggaaacattcaacagcaattggaagatattaaatcttttgttgcagagaatgtagatttgttgattatttctccattggaggacagtactttaattgatgcttttaatagtttggattttcaaaatattccggtattattagtcgatcgtaagatttcttctaataaatatgtttcgtttgttggagccagtaattgggaagttggtgtacgggctgcaaagtatgtattacagttacgtggtgataaacaaactcgtattcttcacattcggggatttgaaaattcaacagcgacaatagagcgtgagttaggatttataaatacattacgtaagtacgaaaatatggaagttcagacattgacttctggacaagatttagggggtaaaaatgtaaattctacgatacggatacttaatgacaatatctctttgttgaaaagcgttgacgtaatctatacttataatgatgctattgctatagctgcttacgatttactcaaaaaagcaaatacgggacatatgcctactattataggtgtagatggtatgcttggatataagaagggtataaatgctgttatggaaggtactttagctgctactgtggtttatccgacaggaggcgctaaagtgattgatgtagggatgaagatcattaatcacatatcagttcctaaagaaaatttgttgtctacgatcttgatagataaaagtaatgttcaggcttattatttgcaaggacaggagattgtagaacttcgtcaaaagataaatttattacagcaggagaaaattgctcaaaagaatcaatatagacagattgtacaatggggaattgttgctgtaagtattcttttgggtggatggggaatatttattgttttattatatataaaaaagcgcaagaataaaccagttctggaggtacaagattctgaaaatgaagataacataagaaaagagaatgaagattatgctcaatttgaggagagggtgttatgctacataaaagagcattatatggattatgattgcgatttgagtatattgattaatgaattggctatttctaaaattaatttttacactactgtccaataaaagttggttaatgggcctttgaaattgttgaaatacagtcttttaagcagtattttagaatgaaacggatttgaattcgtagcttagcggtcaaattgaatgccgcttatgaaccaagataaatacgtattcgctcaacttaccgcttttatgaacagaacacaattcaataactttgttcgcaagtataatggtaatcgctacgtgaaacaattcacctgctggaatcagttacttgctatgatgttcggacaactgagcaatcgtgagagtcttcgcgacttaattgtagcttttgaagcgcatcaagccaagcaatatcatcttggtctgggacgcaatccaatagccaaagccaccctcgcttatgctaatcagaatcgtgactacagaatctttgaagacttcgcattctatataatgaaggaagcttgtgaaaagcgagcgaccaacatcttggatattccaggggataagtatgcttttgattcaacaactattccgttgtgtctagccacatttccatgggcgaagttccgaagaaagaaaggaggtgtcaaagctcatgtcttatatgacattgaagcacaagttcctgccttctatactgtaaccacagcatcgaagcacgactctacagcgatgtgttcaatccattatgaaccaaatgcttattatatattcgacagggcttatgactcttttaaggaactatataggatacacctgacaggttcctttttcgttgtcagagctaagacgaacttgaaatacacaatggttaaatggaagcgtaggatgcctaagtatgtacttacagatgctgaagtgaaactgaccggatacctctcagagaagaaatatcccgagtcattccgactcattcgttactatgatgaagagggtgaccgtgagttcactttcctgacaaacgcaacacatatttctgcattggacgttgctaatctctacaagaaaagatggttggtcgagctattcttcaaatggctcaagcagcaccttaaaataaaaagattctggggcacaacggaaaatgctgtccgcattcaaatcagtgtagcaatcatcacttactgtctagtggctattgtccaacacgatatgcaattgaagcgctcaacttatgaagttttgcagattctaagcatctctctaacggacaaaactaacttgcgtgaactgttcgataagactgatttcaacgatgtcaaagaactcgattatcccctttttgaaggactatttgattaattttttaactagtccatttttattggacactaatgtaatttttacaaacagtttaagttaactttcaaagatactcccaataattttttgaaaagatttagattggataaggcaaaagaattgatacttgagggtaaatatacgtatgctgaaatcggatataaagttggtttctcttcgcctgcttattttactaagtgttttaaggaggagttcaatatgacgccttctcaatattttgagaaaaaaacaaaaaaaaacatcaaacagataggtgcttttattggtactgataaactgttttaaagtatttcttgtctttatccctcccgaaagaggtaaaaagacctgcagatgcttcaactgaaacgtctgcaggtctttttgttttttgtacaaaaaataaaatgttttgtacaaattttcggtcaagcactacgacggtgtttcttacttatacgcttgatccagaaataatatcccgtaagtggcaagatacctccgatgaaagccgacagaaagtacagaatgcgggtaatcactcctccccattgtcccgtatgaagcgaataaataagtcctttcatcttactagaaataggttgcttatcggcatcgtatctttcgatagcagtaatctttccggtatgtatgtcgaaagaggctgtatctcctttccgttttccggtctgaataatctgtacactatttctactcaacaggatgttaccgtaacgattgtagcggctttgcagttctgaaagtgcagtgtcccatacttgataatccaatttttcgggtttgctcttcttttctttcttgtctttgttttctttggcaggtgcagtgtgttgtgtctgttctgtagaagcaccaaacaacgcataaaatccggtgcgataccatcggaacgaccaggttggtccggtaagggccataactaacaaaaacagagtagcataaaagcccaaagagacatgactgtcgtaccagaaccggaaagaccctttgctgcatgaaaccttcaatcggttgtgcaggctcttacgagttcggggccaccagagtatgatgccggaaactaaaataactatcatcagcagggtagtgatgccgacaattgtctttcctgtagaagaagctcccttttgtgcaggggcatcgagcagccagcgatgcagtttgcgaatggtctggaagaaagcgtttccttctacccatccgtttatttctcctgaataggggttgacacttaactgacgttgcccggcattggtgaaacttaccatccacgcttctttggggttgctggctatttgcagagtactgatttccaacgtatctcctgtttgctggcagacgcgtgtaatgatttctgatggctttaagggtttactgccttcttcatattttacagtatataaatgagggctgcaagcacgggttatttctttctcaaaaaccagggttgcccctgtcaggcagattaccgagataatcagtccgacggggacggacagccatagatgtatttttttgaatattttcttcattgttactctcagaatgatttaggagataataaacctacggcagcaacttcatctgctatgatgcttattcctttcgtagcaatggctgtagctggatctattttatacaaagccggataattaccgtcgttggttactacgggaatataagccactccgttggtacagaaaggagtacccagtgatgttatactactctgattgggtaatccgcttgatacagtcgtgagttttccgtcttcggctttaaatatagccagttcggtcacaacagcattctttccattcatcatgcctgctactccgtctgtgtacatttgcatcaggaagtaatcctgcgtgatgtgccagcagcggaacatcggtttcttgttgcctaattcttccaagttataataatagttcgagtcgaaacttgtttcgcctgccttgatgcgcataactcccgaaggaagtgtaccggtcacttttttcaggtcgctggaagaagttgccgtacgtccatatcccggagagaaaacatataagtcgccgttatcggcagcccagatggtctgataatactgtgaacggaatcttccgcaggcaaatccgattttatctgtttctacaatagtaggcgtttcattgaagctgtttccgttgtagatggcgataaatgccttgtcgggatactgagtagcaggtatttgtccggctgtatacgatccggaaccactgcctccatccgatttagcaaccaaatcggcatctgttatcttatcggggaatgtattgacaccgtaatgactcattcccatgggaatgaccgaagtatagagcttgttgtttgcttctacgaagcctgcgaaactcacaaattcaccatttccaaggaagtcttcggcaatctgtgtacctgttgttgttttgccattggtagcattcaggtagttgaactgaagatatttggcaaaatgttctccgtctgtttccttgcttccattattggtagaagcagtaattacgttgttgccccagataccgtacgttgtaatgcggttgaatgtatacgaattatgttctgcaggctttccggtcgactgttcgagtatgtacgaagctcctgtacccgcctctccgttgttgtatttcaagctgaagagatagtctgtaccatagaaaacccagtatgaacctccgatggtttcggttccttttcctaccgaagtaatggttccttcgtcgagtgattcggaagtgataagataagtagcgtcaccagtctttgccgcaatgacatattgattggttccggttgctgatgctcccggatttccagttacatgttcttcgctgcaagagctgaacagattggctgaacagatagcaacagccagagcctgtgtgaaatattttttttgcatgttcttttatatttaaagtatgattaatttccaaaattcactcttatttttccgtagaaagcccgtcctgctttttgcaggctgaagttatcgtacagtttggcattggtcaggttacggcattcgaaagaaagattgtaacgccctcctttcaggctgtatccgatgctgagattatgcgagagctgttcgggcacgcggattttagtggtcggatctcctaagttttcccaatacaacgggaaatcgtgctgataatatccgtcgtatcccaatgttagtacatttcctttggcaaacaaatcgtgccaagtaagcgaggcatcgaagttggcatacagatacggctgattggggatacgctgtccgtacgtcaggctttcctgctgagtacctccggcacggtatttttcctcgtcgcgggcattcattgaattgaatgtaccccctatgttgaaccagcgggagtaattatatcgcagtgagatgttatatcctttagtcttcaccctgccgtggttctcgtaatatccgaaactcatgttgcttacctgcgacaatcctcgcttgatatagtccttggtatcgcgataaatcaggcttccttccacgtaaatggcatgcttgccgatatggtaggaataactcaggttcaggttgaagttgtcgcttctttccggtttcaaatccgcttttcccgcttccaagtcctcgtcaccgaacagctcatcggtggtgggcagacgatatgccttttcgtaagaaagtttagcctgcaggtctttcacgatgaaataagttcccgcagcaccatatcccagtgaattgagatgtttcttcagcaggatataattacctattccatctgaattttgtgatacaggaccttcattatactggttatagtatttggcgaaggcggaaacattccatttatcggaaggcatgtatcggtacgacagtccggtgatgttcttccgtgtcttctttggaatgctgaaatcggaaagcttggagctgcccgatatatacgaacgagttgtacggtggaaggtactgattacgtgattcagtgtaaaggtatgtacttctcctatacggtaattggctgtaaacgttccgttccagttcgtatttttcgattcattattttggtgcgactgttctcccggtgttccggtatatttcttgtcacccagccagttgtatttgtaggatgcagtatcgatattatgggtaatgttatggttataattggccgttgccgatacatccagcccttcaatcaggagattacgcttgcggtattctaccgacgggacgaacgaatatcctttacggtgtttttgaccgaagactacatactgataaactcccgtctgaatttccttatagaaattggaatagttgaagctgaataccagtcggtctgcccagcttttgtccatgactcctattttcccgataacagcctcgttgtggaacgtatcgttgaaacgctttacgtgatagatttttttcttgtccgtactttcggtaataccgtcgtcgccaaattcggtgatatagttatcgatataatagtcgttgtctgaataattctgaaaagcattgatttcgtacatcagaccattcttgaaagtctgtccgaagttgacatacgatttatgggtgttgaacgagccatacgaataagacgcatcgagaaaccagttgcgacgcttcttattggttacaatgttgacaactcctcccaaagcatcggttccaaagcctacaggtactactcccttgtatacttcaatgcgttcggcaaaattgacagggatattgttcaagtcaaaagccgtgcctgccccttcctgcggtacaccgtcgataaagatctttacatgtttcccgctgaacccatcgagcatgagttgcatgtctgatcctacacctcccgattcccgaagtttcatacccggaagttggtttaatgcctcactcagacttttggtagaattatgcagttccttcgtatcgacagcgactgcattgaatgcagatttcttgacacgtcctactccggtggatgtaactaccacttcatccagctcggttaccgaaggctttagcacaacagtctgtttcgtacgtccgtcggacacgatttcgattgctttttcgtatgtttcaaaccctacggctgaaacgacaagcgtatattttccagccggagccggtagatgataaatacctcgttcgtcggttgtacatccatactgtgtacctttcaagtagacagttgcaaagtcaacaatcgttttatcagtcgatacaactttacccgaaaataacgtacggggctgagctactaaagaaacacaaaaaaatagtgtaattaaagtgagtatgccgttttttatcattgattcttttcccttaaattatgatacctatatacttttcaaaatcattatttttgacaatgcaaagttatatagccagagaaaaggcatcaatcgctaaatttgggtatttgtgttggtaaaaatctcggatataagtaaaacggcaatacctaaatattggtattgtagtttagtcgaaaactttgaaggtatatccttgttccagcagccactctatagagcggggtagagcatatttcatacgtgcctccgacttgatagagtcgtggaacgtaatgatggagccgttgcgagcgtagcgctttacgttttcaaaaacttgcttcccgtttaatcgcttactataatcgcgggttaccaagtcccacattacaatgcgatactttcttttcaataccatatattgtagccagcgcatatgtccgtgagggggacgaaataagtctgtgtgaagatattcgttggccttgtctgtattggcaaggtaatttttgctcaagaattcaaatccccgaatatgattgaatgtatgatttccgatgcggtgtcctctctccactaccatacgaaactcttctggatgtttacgtacattatctcctaccatgaaaaaagtagctttaataccatatttatccaacaaatcgagtacccatggagttatttcagggatagggccatcgtcgaatgtcaggtaaacagatttttcattcttgttcatgcgccataacgcacttggatataaaaggcgcaatattttcgggggttgttctattaacatgaataaatgcagtctttgtgattttcttgaaaaaagaaaatcacagaggaacaattaccaagtcacaaggttttgttcctctgtgtttttctatagaaaaatttatatcagaaatcttattgattttccgggtgggtactgcctacacggcgttccagtaactgataaagttgctcaaacttctgtgcataatgggctgccgattccagttccttgcccgtcttggcatctttcaggttcgacagagctttgcatacatcatccagtatatagaagtgacgcatacattcttcgtatgaaccggcgaaacgctcgtcatcaaggctcagataccagcttgtatactctactgagttgttggccagttgttcaagtatgttttcagctttcttggtttgtcccagttgagcgtaatcgtctgccatttctttcgaactgctataaatatagtcgtgacggacagttgtactaggaattaccttttcacaatagtccaatgctttcaaagccttgtctttcttaccttcttttatcaactgactggcaagctggacaaacaggcgtcggtgtgtgtcacacatacggagtactgtttcatccaggtaaatatcagggttatcgatgccgccaaatttaaatttggtcatcaagttattatacatcttttcactgtcgatacgacgtcctaacttgatattatcgaaaggagtgatacggtaagccagtccttcctgcaggaagttgtttgtcagattcatttgattttcggttcctacagtgatagccatatacatcggacgttcccagttggtattggcaagcatttccagcatcatcagttcactcttgtatagtacacgtttgcctttcagcgaaatatgcatgtagtctggaattgagtcaggagtcagcatgccagaacgcttgatggcttctttatccagtttgatgacaatactgtcggttggaatcatttgcaagccttctttcggcgaacgtacccagtacttcagaatattcttcagttcgtacgggttatcaccaaattcttttttggcttcttccggattctgcttgtagaaattgtttatggtttccattgcttccggacgtacatatacagcttcattgtgtccttgtacatagtctatacgttcccagttgataggaacagacggagaatcgtaggccggccggcgcatctggtcgatgtaccagtctgtctgcaagtagctgaggttacatacacgtacatcggtacggaatccttctgtttcttggttataccagagcgggaaggtatcgttgtcaccattggtaaagattatcggattgcctttgtcttgtacggtactcaggtagttctgtccgaagtcgcggcaggtataacgtccgctgcggtcgtggtcatcccacgtctgacttaccatctgtacaggtaccagcaggcagacgatgcttgccagaattgctgccggtttttcgctcatacgtttgctcagccattcggagatggcggctacacccagaccaatccagatagcaaaggcatagaatgaacctgcgtatgcataatcacgttcacgcggttgctgaggtgtctgattcagatacagaacgatagcaagtcctgtcataaagaacaggaagaaaacgatccagaattgctggattcccttttctcctttgtatgcctgccagaacagaccaataagtccgagtatcagcggcaaacaatagaagacgttatgtcctttattgttcttcaaatcggatggcaacaggctttggtcacctacaagatacttgtcgatgaagggaatgcctgtaatccagttaccatgctctatttctccttggccctggatgtcgttctgacgtcctgcgaagttccacatgaaatagcgccagtacatgtagttcaactgatagataaagaagaacttgatgttatcccactgggtaggaatcttgaccatcagcatttctccgcattgatcatatggaacttgtcgtccttctactcctcccagccagtcttcataagctttggcatgatcggaactccacatacgcgggaaaagcatgttctgtgcatacttatattctgttttgttacgtactacttcgtagctgtccttttcatccggacgttccttttctttacgctggtataccggtgcaccttcggtcatatcgtaagtacatccgccatccacttctttcagcgcaatttttgaagcataagtctgaccatagaacaacgggcgtgtaccgtattgttcacgtcccagatactcacctaaggtaaagatgtcttccggagagttctggtccatcggggtatttgccgatgaacggattacaattacggcatacgaagagtatcctacaacgatcatcatcagacagagcagagaggtattcagtgtacgtgcgcttactcgaagtttttcgggcaggtcagcaaataaataaatggccaatataaccaatacgatgatgccaatcagtacactgctccagccgtgtccgtagaatggaatacctaccagaccgacggtggtaaggaatgagatattcatgagtttgcggctgcggactgtatagctttcgtatactccccatataatgctggctgccagtatgataatgtagataatcagtccggtattgaatgagaatcccagtccgtttacaaacaggagttcaaaccatccacctacttttacgatacccggtacgataccatacaatacagcagctacaagtaccatggagccgatgagagctattatactacctttcaggctggcattcgggtttttcttgtaataatataccagtacaattgccggaatacacagcaagttcaacaggtgcacaccgatagaaagtcctgtcaggtaagcaatcagtattaaccaccggtcgctatgggcttcgtttgcccggttttcccatttcagtatcagccagaataccaaggctgtaaacaagctggagtatgcatatacttcaccttctaccgcactgaaccagaatgtgtcactccaggtataggcaagtgcgcctaccagtcccgaccccatgatggcaatcagacggcctgttgtcatgtcttcttcttgcggacatatcagctttttagccagacaagtaatactccagaacaaaaacaagatacatgctgcactcatcaatgcactcatggtatttaccatgcgggctacttgcgaaggatcacttgtgaactggctgaaaagattagccgtaagcatgaagaaaggtgcgccgggtgggtgacctacttctagtttatatcctgttgtaataaattcgggacagtcccaaaagctggcggttggttctatcgtagagcaatatgtaaaagctgcaatcacgaacgccagccacccgaccagattgttaatcttgttgtactgtttcatgtgagttattttgtttctcattaaagttcattgtccgcaaagatagtgataatcttttttctcattgcagattacacggattttcatggtttttagcatattgatttcactctttatcttttttacccgtcatttttattcatgaaggtttgacctttttgcaagaaaaggataaggaggaaattttataaaagcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgctatatacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgataaaagaggaaaaagtaaaaacgagtttgttatttatttagtcgtgatgatgactttttaatacccgatgaggcaggttgccatgtcccagtaattcaatagggcaaccgaagtgctcttccagccattctgtagggatctccgtatcgggatgataatcaagtgtaccgttcacacaggctatcgatttgacattctgcaatacggtaccgatgtcatggctgaccaaaataatagcccgttctttattgatatcctccagaagggaataaagctttgcttcaaaacgtttgtcgatataggtattgggttcatccaagatcacgacctgaggatctgaaaccagtgcgcgccccagcaacgcacgttgtaactgtccgccactcagttgtccgatggctctcttttccagtccttccagtcccatgcgggcaatgatggcccgtacctgttcgtgctgtctggcggtgaacgaacgtaataaggatttctgcttattcagtccggataatacgacgtcgtatacggagatggggaatttcttgtcgatggaattgtattgtggcaagtaccccatactaatttccggcacaacttttccttctttgtaaaagcgtatttctcccgatacgggatggattaatcccaggatgatttttatcagagtggttttccctccaccgttcggaccgatcactcctagaaaatctttttcgtacacagtgagatttacatcatccagtactagcttgcggtcgtatgccgcatggatatggcttaattgtatgataggttgtttgtccatatatcctttattcacttaaggcttttgctatagctgtcatttctgcctgccatttataacttaacgggttaatggaaacaatctttgctcccgtttccttagctataattgcagcatttcgtgtatcgaattccttttgtataaagattacttgtacatgcttctctttgcaacgacgtatcaatgattgcagatgagcaggtgaaggttcttttcctccttcttcaatgctaatctgttccagtccatagtcgcgtgcaaaataagaaagggccggatgatagattaagaaagtgcacgttttattttgcaggtaggcacggatttctcggtctgtacgttctatttcctgttttaactttgtcagattttccttataatacgctgtgtttgctgcatctaatgtacagagagcatcgaaaatattatcggctatgatataggcattttgggtagaactccatatatggggttctacgccacctgcatgcgagtgactgccatggtcgatatcattttcccgtatcagactgactttatccgacaaattgaaaaattttacttccggtgcattgctttgcagcttttcggcccatacttgttcaaagccaatgtagccaatgcgcagaaaggcttggctttgactcaatgtaacaagctgttgtggagttggatcgtatgtttcaggattacttccttcgggtaccatgctgattatccgatatttatctccagcaatagcctctgtaaaataacggagtggctcgatgcttaccgtcagagtagcttgctgcgtctgttgctgtcgattaccgcatgcaaccagtacaagcaagttaaaaaaaagtatgatatattttttcatgagattaccattaattgtatttggcaaagatacgaaaaaatattatttacctgacggattgttgaggctgttgggcgactctttgtactgggttggggtgatacctgtatattttttgaaagcagtactgaaataccggctggtagaaaagcctgtacgttcggctatttccgtcatattcaggtcactttgtcggagtagctccatcgctttttcaatacgtagcttattgacatactcattggcccccatgcctgtcagcgtcttcaaccgattatataatgatgcacggctgatacctaattcctgactgatgaattctacgttcaatccttcattttccatgttatcggtgataaccttgttcagtttgaaaaggaaggaatcatcggccgatgtcattggtttgtctgtatccgctacgatagagttgcgggtatattttaatcggatttgctcacgtaaataaagtctgtttcgtacactctccagtaatgagttgatttcgaaaggcttttccatgtaagcatcagctccggttttatatccgtctacatggctttgttcgtctgttcgagctgtaagtaggattacctgaatatgattgatattcatgtcttccttgattctgcggcacagttcgtatccgttcatttctggcatcatgatatcgctgataacaatatcagggatttctttgagggcaatctgaagagcttcttttccgtttgaggcaatgtataagttcttaaaactgtctttcagagcttccgttaccatttgtcggatactttcattatcatcgacaaataagcatgaatagtctttagtatttattgagttggctatcggcgtatatttttcttcttctggagctgctttcgtgagaatattcagatattcacgcggagggcagatttcggatgattgggcatggataggcaattcataccagaaacatgctcctttgtcgggattgttgtatgcacctattttccctttatgcatttctaccaaaattttagaataggaaagcccaattccacttccgttcctttcgttcacaccttgataaaagcgtgtaaagagcctctcggtatctactccttgcaaaccaggtccttggtcgatgacggagattcgtaccgattgtttatcttcggtcaattctgtgcgcagcgtgatgctgctatctgtagagctatgtttaaacgcgtttactatcagattcgtaagaatgataatatggcgttcctggtcgaattctacttcccctacttctggtgatagctcgtagagtatggtaatatgcttatcttcttcctcgtatttgaagtcggttgctatttcctttatccattcattcagcggatatgattgtatattaagtttgctttgctccatttccatttttctcaggttcaataccatgttcagcagttctttcattcgtttggactgtttcaggatgcttctgagggtaggatatataggattatcctgaggcattgtttttaccagttggttcagtggagtataaatcagtgttagaggtgtacgcaattcatgattgatatttatcagaaaacgtaccttttcttcatatattttctgtttatgttcttgtaaatcagctttcattcgttcttctttacgatttagcagatagagaatgaaagcaataagcaatgttgcagccagaagtatccataataaattgaaccaccatgtctgataccatacgggtggtatatggagagtgatgacttgttgtggagcagtccatgagccatctttggtactgcaggaaaccgaaacatgataagttccgggggtaagtgagcggagtgtcagttcaggaagtttgctgtctgtggttgattcttccttaccatcaatataccatcggtatacttttttcctgaatatattactttcgtaggccatcacctttataatgaccgttttgttgtcgaaagacaaatcgagagaatgctcatcctgatcgatgtcagacagataacttttgttgttactgataatgtccattagccttaattccggaggtgtagggatggtgatgctgcttttattaccatcaatatacaacatgccgttaatacctcccaggtagatatcaccttgtggggaggcccatactgcctttttgagaaactcattgtcttcggctccatcagactggtccaatgaaatcagtttattttcattgtcaagccatacaaaaagttcttcattggttcctatccatactctctggtgctggtcgcaaatcagtgtggtaatattacttaactgaggggcatttatctgtgtttctaattgtgttgttgggttatatcgaagcactttatcgggaaatcctatccaaaaaatgccttgtgcatctttggaaacgcattcaatataatttccttgtttagaagtataaattgtttctattttgttgttttgacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtttgatgatttatcgtgtaaatatgtttcaagtcatatagatatgtatttatactatcataactgatggggatagcttgtccttcgatggaaatctgactgtcgctgagctgttgtagtcttccacttttcaaataatatctgtgtattttagctgaaagtattaaaaccgattctgtttcatcctgatacaagttgattccttttctaccatataaggctatttgattgataactgcactattttcattgataggacgtatttgccctgtctgtttattaaatatgaatacacctttcgaaaataaggagataagtaattcattttgggaatatttacataatgatacaactttctccccataagttgccggatagtgaacaaactgtttggtatgcggattgaatcggtttactcctcctccgtctgttcctatccatatatcatcagaacctggctcttggaaaaagctgagaatagctttttcactgagtccattggtatatccgagcggaacgtctgcatacgaacggacaatggagtgccggatgttgataagtcctccttttacgcttcctgcccatgtattttcttgtccgttgcgttggtacagactttgtatggagttgataggcaatgaattccggtcacccgatagatgttttaagactgttacagacgttgtttgcggattgatgatattaatgcctcccccgtctgttccagcccatatctgttcgttgtgttcactcaaacacagaacgacattatgacttaacttttgattttcagtgttatatacagcttgtatgttaccctgcttgtcgaaacaggtaatacctcggttataagccgtagtccatacataccctttgctgtctatcaatacatgagtgatttctttctcgttgggtaaaggagattttttctttttcccgctttgtatatcgagtaaaattatcccttgccattggctggtacaaagtaaagtctgatcatcccatggcattatttcacggatagggaaagcattagataatttgatatgtggtagtgcctttatttcttttttgtgataattatattgataaatattattgtaatcggctagtaggacttttcctgtcagtttacaaagtgccgtagctttgatgatgtttccgttttcgtccaataccggagtgaaatgatccgtactccgctggtagtttacagttccattatttgttagtatccaaagattgtgtaagctgtcctcttctatctggtagatttcatttccggggagggaaaagggatttccttcttcatgaaaataagttttcaattcataaccgttgaattttccaagtccctgtttgctgctgatccatacaaaaccattttcttcagcatagatatgttgtatatatggagggaagccatccgatatagatagctgtctgtataaaaactcgtctgcctgtgcaccgattgacgtgaacagaaaaagtatgaaacaaaagaattgggtgatatgagctttcatagtgcttgcaaaactttggagacaaaaatacgaaaattcattgaattaagtatcagcttgtatacttttctataaaaagagaatctgtagaagtttattattatgccaggctattatattttgcattcgcctccttttccttccatttttgtctaaaaatgttcaattttgattatttagcctatattttcagatcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgttcagatagaagggcacttttattgatttttagaaataaattattgattttagaacattgaaaaaaattaaaccttccatttttgccatagtttattaaaccgaggcattaaaaaacattattaactttaaaactatgaaacaaatacgatttaaggtacattcggtttgtatcttctttatgttcttgttgatgcttcctcttgcagcagtagcacaggaagggatgataacaggacaagtagtcgatgaaaaaggtgaaagcataattggtgctaccgttcaagtaaagggtacttcgaatggtacaattaccgattttgacggaaacttttctttaaaagccaaagtaggcaatacattggttgtttcttatgtgggctattcaacccaggatgtgaaagtcactaaacagacaggtgttcgtgtcgtattaaaagaggatacggaagtgcttgatgaggttgtagtagtaggttatggtactgcgcgtaagggtgatttgactggtgcgctgactactatgaagccagatgcaaatgatgctgccaaggctacttcacttgataatctgttgtcgggaaaggttgccggactggtagtcagttcttcttctgcaatggcaggatctgcgtcttctattaccattcgtggtgctagttctttgcgtggtgataatcagccgttgtatgtcatcgataacgtaccgcaggcttctgccggtgaatttgcttcttctggtatcagtggtgacttccagattaatcaggaccccttggcttctttgaaccctgcagatatcgaagatattaccatcttgaaggatgcttcttctactgctatttatggttctcgtggtgcaaacggtgttatcttgattacgactaagaaaggtaaacaaggtaaagcaaaagtgaatgtttctgctaactttacaatagctgagccatcaagactgatggagatgactaatctttacgaacatgcagcttacatcaattcacgtatttcgaacggtcaatatcctttctatattgtgggtgacgaagtgagatatgtatacaatgatgctttggcaaattatgatcccaataacccggaaacttatcatataattaattatcgtaactggcagaaggagatttatacatctgcattctctcagaattattcattgtcagtaagtggtggtagtgataagacgacttattatatctctgcaaactttaaggatattaacggtactgtaaaacagaccggtttgaaacaaggtgacttgcgtgctaatatcggtatggacttgtcgaaaaccgtacacttgaacatgacattgagtggttctcttcgtcagaataacatgatggccggtggtagtacattgggtggttctacaaccgctatatctcgtaccgctcttgattatgctccgtttgaaatgccggcagatgacccttctttcagttcagaaaataaaacaactatattcagttggttgaatgactatgtggatgttgctaatgataagacattcaatgcttctatggatttgtcatggaatattgtgaaaggcttgcgttataacttgcgtgtgggtggtaacctgaacatgaacgaccgtaagcgctggtatggcttgcagttgtatcaaggtatgaacaacaatggttatctggcactgacagatttgaacaaaagcaatgttactattgaaaatgtattgaactataataccaaactaggctcaattgcaacattggatgctacagtgggtgttacttacgatgattataacttcctgagtgaaaatacaaatggtactcagtttacaatgttcgatttgagagaaaacggacttcatatggctggtaatgtacagcacttggctccgactcaaaaagactatcagttactttcttatctgggacgtctaaacttgactttcctcgacaagtatttgattacagcttccttacgtgccgatggttctagtaagtttggtaaaggaaaccgttgggggtatttcccttcagcttctgttgcatggcgtatggaacaagaagaattcctgaaagatgttgattggttgaatcagttgaaggttcgtttaagttatggtgtaacaggtaaccagagtatcgatccttattctacattctccatgtatggctcaaatggtaattatcactatggtagtggaagtggtgatcaggaatcggttttacagattacaaacttgccaaatgacggcttgacttgggaaaagacctcttcatggaatgctggtatcgactttagtttgttacgttcacgtttgagtggtacattcgatttctatgtaaaacgtacaaacgacttgctgatttcacgttcattgccgggttctgccggatttagctctacttattataaccagggttcattggataacaaaggtgtagaattctctttgactgctcaggttattgatactaaggactggaaatggagtattacaggtaatatcggaaagaacaagagtaagattgtagaccttggtttgctgccttcagactttggatgtttgggtgaacgtatcggttactatggtaactcattgggtgaccactttggaataggtcatgtattcttgcaaggtgaagctccgggattgttcctgggttatgttacacaaggaattgtacagccggaagatattacagatcaaggtgtgaagtttatcaaggaagatggttcaattggttactataaggatgtaaatggaagtactccggtagcaggtgatatcaaatttgtagatagagatggcaatggttctgtaaatacttcagaccgagatattatcggtgacccgaatccaggatttacatatggtttccagacttctttatcttggaaaggtttgacgttgagcgctgcctttaatggcgtgcaagaccgtgatgtcatcaacgtaaacaaccgttatatcaatactccgggacagaaagccggtacagtatcaaagaaggcttttgaaggtatgtggacacctgaaaatcactcaaatttgtatccttcttctaacttcattgttcagaatatggtaatggatcgttacgtagaagatgcaagctacttgagatgttcagatattacattgaattatgttcttccttcagcatggatgaagaagatcggtttcaagaatacatcgatttttgcttctgtaaagaatgcatttatcattacagattatagtggatatgatcctgaagttaacagctttgctttcgatggattgcgtccgggtgtagacatgagctcttatcctactcctcgtcagtttgtatttggactgaatgtaacattctaataaattggatttaaataaagatcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtaaagattagattatgaaactatataaatatttgatattatctatagtagcggcttccagtttttcgtcttgcttggatgaggatccgttatattcacagaataatacagtcgttttctcgtctgaatcgagtgcgcagttggctttgctgggatgctatgcgtatatgacttctacatcggcttatggtcagcattatcaggaaattcctattagcggtgccggattcgcatggtcacaacgcagtggtagtgatggtattgtttcgttacaggcactttcaagtgacggattgatttctactacctggaatggtatgtataaagtgatttctgaaaccaatgcctttttggagaatctgtcatctagtggattgagcgatgatattaagaaccagtatggtggtgaagcgaaattcctccgtgccatggcttattataatctggtatctctttggggagatgtgcctttgaaaactgtagcttctacttcagagggtatctcaatgcctcgtactccgaaagagcaagtattgaatcaggttgtgacagacttgaaagaagctatgagcatcagtgaaacttctgaggttggacgtgttaattcgtgggcagtaaaggcattcttgggaaaagtgtactatcggatggcaaagcttggtattgatactaacaataatctgaaaaatgcaaaggagatgttcgatgaagtttataacaagcatgtatatgaactggaaaagaattttgcagatttgtttggtgactgggtgactacctcgaaagaagctattttccagttgaactttgctttgaattctccttcttgctttaaccgtgccagcaaccgtttctcaccgacaggttcgacaccgggtgtatgctggagtacgtatcgtgcgacaaaagctgcttatgatatgcatcaaggtacttatccgggtgatcctcgtatagctgctacatttttgactgcacatagagaccgtggaggaaacaataaaccggaacctaaagctcaggtaggtgataaaccgtcggcaaacgattctgtatattattatccttatttcacctataccgttcagttggatacaaagaaggtaaatggtaaggatgttgctgtatacgattctatctataaaaatggaaaggctgttgctgctaaacaatatgtaggtagattgccttatgagaaatttaaagatccgactaatccggatttaaattatctgaataatctgaatgaagcagatggtaagactccgcaagaaaaagcatatattaaagctttgaagggtatacagaagaaatatgcggagagtggtaatcagatggcatggcctgctcatatgaagttgtatgatcctaaccagcagggaacttcttctcataagaatctgatggtatatcgttatgctgaaatgttgttgctgatggctgatgtttataatgaactgggagatactcaaaaggctatcgaactggtagaggaggtgttgaaacgtgcacgtgaatcagctggtggtaacggtgttgaaccgaaggcatggtctaaacaattaaccaaggatcaagtcagtgaaaagatttatttcgaattcttgttcgaactggatggtgaaccgtcaatgtatgaactacttcgtatcaaaggtactgagtacttgaagaaagctttacaatatcataataatcatgagtttacaaaggcttcggatgcgtactataagacagctgctcagaaatggaccgaccgtctttataatgagggtaatctgacagaagacttcctgaagaagaacttgttattaccgattcctgatacggaaagagatgcaaatccgggtatcacggataataactttggttattgaaaagctatataattggagtctgttgaaaaatcgcctgattgttggttaaagtttcttttaagggtttcctgaagaaaagggtaaaattgaaaacagactcttgaaagctcgcataattacattcttttattataaagcttattgtaattgtgcgggcttatttaataaatttttataggattttgatggattcccttctgtattagctgaatgatgggtgaagtattttctgcatcatatttttacgtaatctttattagcactacagactcaatgtttgtaatgattttactccgaataattaatatataaatatgaaaaacctgaatttattttattctatggctggattgagtgctttggctgcaacagcgtcttcttgccagcagaataagtcggaagcaaaaaaaaattataatattgtttatatcatgaccgatgatcatacggcgcagatgatgagttgctatgatacgcggtatatggaaacacctaatctggaccgtattgctgccgatggggtacgttttacgaatagttttgtggctaactcattaagtggtccgagtcgtgcttgtatgattacgggcaaacattcgtgtggaaataaattttatgataatacgacctgtgtgttcgacagtgcccaacagacttttcctaaattgcttcagaaagcgggataccagacagctctaataggaaagtggcatctggagagtttacctaccggatttgattattgggaaatattgccgggacaaggggattattataatccggactttattactcagaataatgatactatccagaaacatggttatataaccaatctgataacagatgacgcgatagactggttggaaaataaacgggataaggataaacctttctgcctgatgatccatcacaaggcaattcatcgtaactggatggctgatacgtgcaacctggcattgtatgaagataagactttcccgcttccggaaacattcttcgatgattatgaaggtcgtccggctgctgccgcacaagaaatgagtatcgtaaaagatatggatatgatttacgatctgaagatgctgtgtccagacaaggattcacgtttgaaaacattatatgaatcattcctaggacgtatggataaagagcagagagctgcttgggataaattttacggcccgattattgaagatttctataagaaaaatcctcagggtaaagatttggcaaactggaagtttcagcgttacatgcgtgattacatgaagacggttaagtcgctggatgataatgtaggacgtgtattggattatttaaaagaaaaaggtctgttggacaatacgttggtggtttatacttccgatcaaggtttttatatgggagagcatggatggtttgacaaacgtttcatgtatgaagaatcgatgcatacacctctgattatgcgtttgcctgaaggattcaatcgcagaggagatattaccgaactggtgcagaacattgattatgctccaacgtttttggaacttgcaggggcaaaggtaccggaggatatgcatggagtttctttattgcctttgctgaaaggagaacatcctgctaactggcgtaatgctttatattatcatttttatgaatatcctgcggagcacatggtaaagcgtcattatggaatccgtactaaccgttataaactgattcatttctataatgatattgatgaatgggaactttatgatttacaaaaggaccctaatgagctgcataatttgtatggtcagagtgactacgattcgattgtcactgacttaaaaaaacaactcttggaattgcaggagaaatataatgatcctgtacgtttttctccagatcgtgataaagaataaaaaatcagagagattatggttaagatatattttcagtcgaaaaaatggataatggcttgtattgcagctttggcactgggtatagctggatgtcattctccgaaacaacttgaggatgtagttattgttcctcagccgttgtctgttgaaaagggaagtggctctttctcttttagtgggaaaactgtcattgctgtagctgatgatgaacaacgtatagtggccgaaaattttgcttcgctatttactaaatcggcggatttcacccctaaggttgaaaaggcaaaagatggcaatatcgttttttctattgatcagtcgatgaaaacagacgcttatgaattacagataacttctgataaaataacgataaaggcagccgatgtgaaaggtttcttttatgccttgcaaaatattcgtctgatgcttccccctgcaatagaaggacaggagcatgctgcggaaacatgggctgtacctgctgttattataaaggacgagcctcgttttgattatcgaggttttatgctggatgtttctcgctattttttaccaaaggaagatgtgattcggatgattgattgtatttctatgttgaaaattaatcgtttgcatctgcatctcacagatgataacggatggcgtctggaaataaagaaatatcctcgtctcacagaagttggagcatggaaagtagatcgtcagaatcttccttttcctgatagaagaaatccaaagaagggagaacctgctactgtaggtggattttatactcaagaagatatgaaggaaattattcgttatgctgctgaacgtcaagtggaaattattccggaaatagatattcctgctcattcgaatgctgctttggcttcttatccagaatatgcgtgtccagttgtaaaagattttatcggagtattgccaggtctgggtggaaagaacgctgaaataatcttttgtgcaggaaatgataaaacctttactttcttgcaggatattcttgatgaagtgattgcattattcccttctcgctatatcaatttaggaggggatgaagccgctaaaaccaattggaaaaaatgtcctttgtgtcaagcacgtattcgtaaggaacatttggctgatgaagaagctttacagggatattttatgtcacgcataggagattatgtccgtagcaaaggcaagcaaattatgggttgggatgaactgacgaatagtaagttgccgggagagtctattattttaggctggcaaggatatggaaaagccgcgctgaaagcagcggaacagggacatcggtttataatggcacctgcccgtgtagcctatctgatcagatatcaaggacctcaatggtttgagcccgttacttattttggtaataatacattaaaggatttgtttgagtacgaacctgttcagagcgactggaagcctgaatacgaatctttgttgatgggagttcaagcctgcatgtggactgaattttgtaatgtacccgaagatgtgttttatatgactttcccgagattggctgctttggcagaaatagcatgggttccaaaagggaaaaagaactggaatgaatttttgaaaggattagataatttcgacaaacatctggagcaaaagggaattatctatgcacgttctatgtataatattcagcataaggttacaccggaagaatctggaaaattgaaagtggaactggaatgcgaacgtcctgatatggaaatacattatacattggatggtactgaacctatggaaacatctgctgtatatgattctgcttttgtcgttgataaggatgtggaaataaaagccgccacttttactaaaggtaaacagatgggaaaaacgcttatattacctattcattggaacaaggctacagctaaaccgttagtgggtgctccaaaagaaatgggaatattagtcaatggcttacgtggaagtctgaagcagactgattttgagtggtatacgggaggactatcacaacctatttcttttgttatagatttgttgaagcctgaaaaaataaaacgttttgttgttggttgcattacgaattatggtatggctgtacataagcctcgaatgatgaaagtggaagtttcggacgataataagacgtttaaagaaataggaaagttgacctttacggatgatgaaatttttaaggaaggtaattttattgaagatttatcgattgaaaatgttgatattatcggacgttatattaaatttacactggaaactccgggaaattgtccagataatcatgttcgcccgggacaagcgtctaaagtttatcttgatgaagtgataattgagtaataatttgacatataaataaactgcatgaataaaataaaccagtttttaatggcgtgttcattgcttgccctccctgttggggggcaagctcagcaggatacctcttattttgtaaagcatttgcagttttctggaaatgaaagcttggagcagaaagcttcaatggcggcccgtttagttccctctccgcagcagttggcctggcagcagatggaactgacggcttttttgcattttggaattaatacatttaccggtcgtgaatggggagacggtacagaggatccttctttgtttaatccgacagaactggatgctgagcaatgggtacgtaccttgaaagagtgtggcttcaagatggtactgcttacagccaagcaccacgacggtttctgcctgtggccgacaaagacgacatctcattcggtggcttcttctccgtggaaggacggcaagggtgacgtggtgcgtgaacttcgtgatgcatgtaccaagtatggcatgaaattcggtgtatacctgtctccttgggaccgtaacgcttcgtgctacggtaattctcctgaatacaataaattctttatcgaacagctcacggaattgttgaccaattacggtgaggtgaatgaggtatggttcgacggtgcaaacggtgaaggtcctaacggaaagaagcaagtgtacgactgggatgccttttataagacgatccagcgtttgcagcccaaagctgtaatggcgattatgggtgatgatgtacgttgggtcggtaatgagaaaggtatcggtcgtgaaacggaatggagtgcaacggtacttactccgggaatttatgcacgttctgcggaaaataataaacgtttaggggtttacggtaaagcaaaagatttgggcagtcgtaagatgttgcaggatgcaacggaacttttctggtatccttcggaagtggatgtatcgattcgtccggggtggttctggcatgaggaagaaaatgcaaaagtgaaaagtctgaaagaactgtcggatatttattttcagtcagtaggctataattcagttcttttgctgaatatacctcccgaccgccgggggttgctgaacgaagccgatgtatcccgtttgaaggagtttgcagcttaccgccgccgggtcttttcggatgataaggttcagaacggtaatgtttcatggactgcatgtgcgggtgaatcccgttcgtacgtcattcgtccagcgagtcggctgaacgtggttcaggttcaggaagaaatctcgaagggtcagcgtgtggagaagtttacggttgaggcttaccgtaacggcgtctggcagtcattgggtgaaggtacgactatcggctataagcgcatgctgcgcttcccggagctgacggctgattctatccgtatccgcattgattcgtgtcgtctttgtgcgaatatatcggatgtatctgcttattatgctccagctcttgcaaatcaggcggcagttgctgactggaacacgcttccgcgcaatacgtggaaccggttgtcatcttctcctctggtgatagacttgggcaagcaggtccgtctgaaggctttcacctacgctcctttgaacggagaagctaaaccaacgatggcttatcattaccagttctctgtcagtgaggacggaaaggagtggaaggtattggtatcggatggagagttcagtaacatcatgcataatccgttgccccagaccgtaagtcttccgtcggtaccgacagcccgttatgtgaagctggaagcaacgactccggatgattcggctgctgtcattgagatggaggagctgggagtaactgtggttgatgataaagatgatgaaacaaaagtataccctcatccggatgaaacattaaagcttaagccgggtgatgttcatcctacccagaaaggatggtatttttataccgcccatgagtttttggataagtatacaaagaagggactccctttaggatttcaagaacataagactcaaacgatgagtaagtcggcttgtgtgaataatgcaaggtgctctaaggtggaaaatggcgtattgcatatgtggccagtggaagaaacggattcaatagataacggtttcgggaaaaacgtaaaattttcgcatgcggcttatcgttcggtaacttctggaaaacaggcttggtgtaagtttacagaaaatatgcgaatagaaattcgttttaaacgtacagctgcagaagggtttaatgaagctctttggtttatgggaaacaagggaccatggccaaagaatggagaaattgatttattggaaaatcccaaaaagcaaataaaccagcgtgctcattttactcttcattcagaacaccattatgcaggtgtagtaggaggtaaaggaagtgttacctctagtatcaatctggcggatatgagtcaatggaatatttattggctggaatggtatccggacaggattgtgggaggagtgaatggtaaagcttattttgaacataaaaaaggggcgaatggtaacattgattggccgtggagtgatcttgccggattttatctgatatttagtacgggattatctgtcgatccggaggcatggccgggagccgttgattcacaaaaatggagcaagcaaaatcctccttccatgtatattgattgggtacgtgtttatgttaacgataattacaatcgagataaggctccaaaagtaagatattattaatgaaatttttattttatgcgaaatatacttgtttgtttaatgtgtgtatgggtatgtgctgtttgtacagtacatgcacaagtgggttttgctcggaataaattgtacaatattgtacctgtcaatcatccgggtaaagtattgggatatgatgctggtagccagcgtgtgttattaagtaatagtaatgaagctgataaattgcaacagtggagcattacgaatttgtccggcagttttcgttttataaatccttttgaaaacaaggccgttcatgcaaagggtgataacacattgggaataactgaaaataatggttctgatgaatctcagttgtggcttgtaaagaagaatggtaaatatttacagatttttccatccaatagtccggaactgatattgtcttgttcttcaaacggacagtttacattggttgataaaacaaagtttgtaactaattcagaaacatatttctatatcaatgtcagtaaggtagcaatgcctgcagagaatgtatcaggtccttctgagcgccctaaggtttattgggaggatgaaaccatgtttggagagcataaagagcctggctgcgctacttatataccttatatgacagagaaagaaatgttgtcggataaagatttttatcataccccttgggtgtatagtaagagttctacttttcaattgttgaacggcaactggtcttttcattttgttcctgaaccttctcaacgtccggaatccttttataaagaagactatgatatttccggttgggaaacgattcccgttccttcaaattgggaaatgcaaggatacgaccgtcctatttatgcgaatgtagaatatccacatgccaatacgcctccttatataaatgctcgaaaaggcttcaacgatggaggagttaattatggtattaatccggtcggttcgtatgtgcgtttcttcgatttgcctatcggatgggaaaaacaacgtacgtttattcattttagtggtatatacagtgccgcatttgtttatctgaatggagaatatgtaggttatacgcaaggatcgaacaatgttgctgaatttgacttgacgaaatatttgcgtacaggtaagaatcgcttggctgttcaggtctttcgctggagtgacggttcttatctggaatgccaggatatgttccgtatgagtggtattttccgtgatgtttatttgtacaatgttcctttagttagtgtgcgtgatcattatataacttctaaactggacgctgcttcaggatatactaacggtgaaatgtgtgttgatttgacactcgataaccgtgaccgaattaaaggtgtaaaaaatctgattgtaaaattattcgatccggaaggaaagctggtagcagaaacagagcagcaggtgaattattcagaaaataaggatgctatccatactacggcaacctttaatttgaagaatcttgttccctggactgctgaaactcctaatttatatactgtgcatgtgattcagcgaaacggggataaagatgaaatggccttttctaccaagtatggattccgtgacattgagttaaaaggtacacttgtttatattaacggacagcgagttttcttcaaaggagtgaatcgtcatgacacacatccggtttatggacgagctgttacggttgaatcaatgttgcgtgatgtaacattaatgaagcagaataatattaataccattcgtacttctcattatccgaatgatgcgaaaatgtatgtcatgttcgattatttcggactgtatacaatggatgaggctgatttggaagaccatgccaatcagtctatcagtgatatgccttcttggattccggcatttgtcgaccgtatcgatcgtatgatactccgcgaccgtaatcatccaagtgtgattttctggagtctgggtaatgaagcaggaggaggacgtaattttcaggcttgttatgatgccgccaaacgtttagacagtcgtcctgtgcactatgaaggtacacgtgacggaaaagattatggtggcaatcgcttcagcgacttgtactcgaagatgtatccgggtatgaaatggatggatacttacgtaagttcactggataaaccgatgtttatttgtgagtatgctcatgccatggggaatgccatcggtaatttgaaggaatattgggaaagcattgaaggaagttcggctattattggtggtgctatctgggattgggtagaccaggctatttatgaaccccatgagataaaaaaaggtatttatcgtttgcatacaggttatgattttcctggtcctcaccagggtaatttctgctcaaacggcattattcctgctactcgtgaagaatcgcccaagctgaaagaggtaaaggctgtatatcagtatgtatattttggtaatgaaggagttgatttaaaacagaacgaggcaagcgttttattgaaaaatacttatgacttcctttcacttgataaattctatttgcgttggcaaattacgaaagagggggtatgtcttgaatctgatagtatgaaacttccagctgttatgcctgatgattcattgttggttactttaaaattgaaaaatgttaatttgaagaaagcaataaagaacggagaagaggtgatgctcaatttgtatgtgtgtcgtacagatgccgaaaattgggctgaggctggtcacgaggttgcccaacaacaatatgaattgtcatctcgttgtggattgccggatttgaaaaaccagagtcataagaaattgaaactggatgtttcagagaatggaaacttattgactgtcaagaatgcaaatatcgaggctgtgttcaataagagtaatgggcaaatgacttctttgttgatgaatggaaagcagatcattagccaaggaaatggatttgtatacgataatcaccgttggatagaaaatgataaatttaccgaaacgggtaatggtctcgaagaaaaaggtacgtgtacggtgactgaaaaaaatggtgatgttattgttacaacaactcgtaaaggaagtctgtgcagtacggatattacgtatacgtttacacaagctggtgtaatggatatggatgtcgtttttcaccctcagacagccgatttaagacgttgtggattggttgcagacattgattccaccttgagtcagattgattactatgcgtacggtccatgggaaaattacaatgaccgtaaagatggttgtatggtaggtcgttacaccacaaccgtagataacatggacgttccttacatgaagcctcagtctatgggaaatcgggaaggcttgcgagagttgactttacgtgatgctgatggtaaaggaataaccattcagaccgaaggaaatgtttcgttctctgctcttcgttacacagataaagatttgatggaaggacaacatgcgtgggaactgaataaacgcccctacattgtactccatttggatgctgcacttcgtggggtaggtaatgctagttgcggtcaggatgtagatacattaccgatttatcgggtaccacagcaggaaatgaaatataaactgcgcttttctgcttgttctttaaataaataaatgtatcttagtcaggagtcaaagttgataaaaggatttttttattgcttttatcaaccttgactcctgattttttgttcttataccttgatattaactgaagttatagtaatgtagcttcataaattagttttttgctatgaaaaaattacttgtatttttattgggggtattatctgttgccggattgaaggctacagatacggtttacataaaagcgcctcaggtgccggttctcatagaacggcatgataatgtcttgttttatatgcgtcttgatgcgcaggatacaaaagtattggataatgtatcggttacgtttggaaaggatgttccgttatcacaaattaaatcagtcaagttatattatggaggaacggaagcccctcaagatagagggaaaaaacgctttgctccagtagaatacatctcagctcatgctcctggacgaaccttatcggctaatccgtcgtatgctattaagaaatcagaagccactccgcaagagcgtactgtattattatccggtaaccagaatttatttcccggtacgaatttcttttgggtaagtatagaaatgaaaccggatgcatcattactgacgaaagtaacggctcaggtaactcgtgtagaagcagaaggaaagtcgttacctgttaagtgcgtatctgcatcggatgtcgtgcgtcggatgggagtaggtgttcgtcatgcgggagatgatggagccgcagctttccgtattccgggattagttacaaccaataaagggacattattgggtgtatacgatgtgcgttacaataacagtgtcgacttgcaggagcacgttgatgtaggattgagccggagtacggatggtggaaagacatgggagaaaatgcgcttacctttggcctttggagagtatggtggacttccttcggctcagaatggagtaggcgatccttctattttggttgatacaaagacaaatactatctggattgttgctgcatggacacacggtatgggtaatcaacgggcatggtggagttcacagcaaggtatggacttaaatcatacagctcaattggtccttacaaagagtacggatgatggtaagacttggtcggagccgataaatataaccgaacaagtgaaacagccggaatggtatttcttgcttcagggaccgggtcgaggtattacgatggaggatggtacattggttttccctattcaatacattggtaaagaccgcattcctaatgctggaattatgtatagcaaagacggagggaaaacatggactatccataatcatgcccgtaccaatactaccgaagctcaggtagtagaagttactccaggtaccttgatgctgaacatgagagacaatcggggaggaagccgtgctgtatatactacaaccgacttaggtatgacatggaaagagcacgaatcatcgcgtacagcactgccggaacctgtttgtatggcaagtcttattagtgtaaaagctgctgataatgtattgggtaaagatattctgatcttctcaaatccaaatacaaccaatgctcgcaagaatattaccattaagattagccttgacggcggaaatacttggactccagagcatcaattgcttttggacgaaggagaaaactggggatattcctgtctcaccatgattgatgaggaaacaattggtattctttatgaaagtagtgtcgcacacatgactttccaaactattaaattgaaagatatcgtgcagtgataggaaatctttgatgaaataatgcattgaagtaaaaatagatacttcctcattatcaggctaaaagagtcgtatcaatcagttgaagtctactggagattgatgcgactctctattttattatagaacgtccaaaattagcatttcatcttttgattagtagggcttgagtattcttatgtctctattttgaagcccttaatatttcacgttttccacccggagggcccggaagacgttctaccgtaaatccggcagtttgcagcatacgacgtatgactcctttggcacagtaggtcgtgagaatgccacctgaagaaagtcgagcatacaaggtattaaaaagctcctggctccacatctccggttgcttttccggcgcaaatgcatcaaaatagataacatcgtattctccttgaaaatcatactttgtaaagtcgttcattaatttatgcagggtaaagtagggagtaatctttacgtcggcattccattcggtcgtatgtaatgcataaaaatcgtcactgcgttttggacaaatctgttcagggtatttcagacgatgaattaggtcatcggatacgggataacgttcgatggttgtatagtgaatatgacgttgacttgtatcggcttccagcatggtaaggaaagcattcagcccagttccgaagccgatctccagtactcgtggggtagaggatgggcgatgtttcaaccccatgttgataaagatatgttccgattcggttaacgctcctttgatagaatgataatgttcatccagttccggtacgaagagcgtgtagcttccgtcggcagtttgttccagtttaatcataatgcattcatgtaaaataaatcagaaaaggctgatcacttccagagtggcagctaccagtatggcatagcgggctaattttccgatggtcatcgataaagtgacgataccaatatgtgcacgcatcaatcccagtacgattaggatagcatctcctacgacaggtaggaaagaaaacagagccatccatgcccctcttccatgaatgaatcgtgtagcacgttccatctgttttggggttactccgaggtatttttctatccattccatttttccaagatgccctatccagtagcatgtgagtccgcctaatacgttaccagctgttgtagaaatagtagaccatacggggtcaagtcccagtcccacgcatgcaagcaacacggcctcggaactaaatggaaggatggtacctgccagaaaagccgacaggaacattccaaaatatccccagtcggtcagaagttgaagaaatgtatccataaattaaataagcaaagtacaagccatattacaagagttgcgataaacagtattcgggtaaaccgtgtgaatgttaggggaaataaatgtcctcccatgaataccattgggataatagacaatggcaacagcgcatctatatgcgaaggttggagagcaatgaggatatttatccatattcccatgaaaagtatgacttgcagtaaaatacgagtttgtaccttatccttgtaagctgtttgcagataaggaatgctgtatataatccaaagtatcactatggtaccccacagaatataacgactgatgtgtatggtagtatagtctatcggatcaaactgtattagtcgtgaaacaatgggataaaacgaggtaatctgatcggtatatagataatatccaaacaggaaccagtatggcaaggtaaatcctatgataccggcaaagaacgtttttccttcgagcgaccggagattgatcatgtgaatataaatcagtggagctatccaggcaaagcaaggtacaataaggctgctcagtcccatccagaaaaatgcgtgaaagatggaagtagaggcatgtggtgactcatagctttggaatagtgaatagagcatacatataaaaaggatcggaagaagtaattccacattccacgtatgcaagaagggagttgctgcataaaacaaaagaaacagcgaagccggaagtgaagtccgggtacgtatgagcgcaaatttagtatctgtttctacaatcagataagtagcgataccgaaactgagtaatgaaccaatattcgtccatagctgtggagtagatatggtccataagaagagtgtcagtatcgttactacgggcagtgtagcacgtcccgttgcaacttcgtattggaatctgttttttgtttggatcatattacagcatgtttcattgcagaaaaatcaccgcagatgataccggaacataagtataatgcttactgctatttgcggtatcatctgctggttgatgatatattacaaatcgaagccgatgtcagaacggaaatatttcttttcgaatttaatttttccggcgttggtaaacgattgtttcaaagcttcttccttgttggctccatacgagctgacggcaatgacacgtcctccggatgtaacgacctgaccgtctttcaaggctgttccggcatggaatacgatgctgtttccagctttcgcatcgtcaatacctgtaatcgggaaacctttttcgtatgcttcgggataccctcctgataccagcataacacatacagccgagcgtggatcaatttcgagtgtcttttctgccagattgccggcagcaaccccctcgaacaagtctacaaggtcactcttgatacgcagcatgacactttccgtttctggatcacccatacggacgttgtattcgattaccatcggatcaccctttacgttaatcaggccgaagaagataaatcctttgtaatcgatgccttctgcagccagtccttctacggtagggcgaatgatgcgttcgtccacttttttcatccaagcttcgtcggcgaacggtacgggagaaacagagcccatgccacctgtattcaggcccttgtcgccttcaccaatacgcttgtagtcttttgcctcaggcaatattttgtaattctttccgtcggtcagtacaaagacagaacattcaataccactcagaaattcttcgataactacagtggctgaagcatttccgaacataccgcctagcatttccttcagttctttctttgcttcttccaaagtagggagtatcaatacaccttttccggcacacagaccgtcggctttcagcacataaggagcttgcagagtttcgaggaaagcaagaccttcttccagattggctgaagttatgcttttatatccggcagtaggaatgtgatggcgctgcatgaagcctttggcaaattctttactgccttcgagtacggcaccggctttcgacggaccgataaccggaatattggccagcgctgcatcgtttttgaagaaatcgtagacacctttcaccagcggatcttcaggacctaccactaccatgttgatgccattcgctacaacaaattgtttgatagcttcgaaatcatcagcttttatggctacgttttcgccaacttcacgtgtaccggcgttacccggtgcgatgtataacttttcgattttcggactttgagcgattttccatgccagtgcatgttcgcgtccgcctgaacctaacagtaaaagtttcatattcttagaatgttatgatttgttgtctttattttatttcagatgatcaagaaaataacgagtaatgtgttcgtgcaaatgtacacggtcgcgtcccatcatgttatgtccgtcttccggataaatgaaaaagtccggatgagttccagcatcgatacaagcgcgcaggaaactgatgctgtgttgcggtacacaagttgggtccatacctccgataatgatttccaaacgacctttcagattgccggctttcaagcgaagattagaacctttgtatccttcagggttggtctgaggagtgtccatatatctttcaccgtacattacttcgtaaaattgccagtcgataaccggaccgccagctacccctaccttaaatatgtccggataagtcaacatcaggtttgtggtcatgaatcctccaaagctccatccatgcacaccgattttgtctgcatcaacatacggcagtgattgcaagaatttggctccttctacctgatctttcatttcttctactcccaaatggcggaacgtacaattctcgaacttgatgccgcggttatcgcttccacggttgtcgacggtcagcatgacataaccttgctgagccatgtaaaggtcccatccacgtgcgtcgtaaaagcgtgtattgtgtatcatctgagcatgcgggccaccgtatacgtagatgatagctggatatttcttgttcggatcgaaattgactggcttgatcaaacggtaatataaatcagtttctccatcggctgccttaattgttccgatcgtaatctcgggtaagttgtatccctctttcagtggatcggttgcagtgaacagggtgacacccttttttcctgtcgtagggagaatacttatttcacgtggaacactgtttgatgtgagataatcaatgagatacgttccactggccgaaagttttgcctgatgggtaccgtcggctatgccaatcaaggtacgttttccgttcttcacgtccagactgaatatattagtctgcaaaggagatacttccgtacttgcgatgacaatttctttacgagaagcattgaatcctaaaacatcttgaaccagccagttgccttccgtcaatggagttgttttcaggtattcacaatattgatcttcactatccttacctgtttcccactcacctttcagtttggtttttgtatccatgacgtacaaatgattgaaaccatcccgttgagtctggtaaataaactggctgtcatcccaaggtaagaatatcagaggatgctgaggctctacgtaacgagtatgtttctcctcgtaaagtacccccatcttttgtccgcttacagcatcatactgaaccagttgtgcatgattctggtcgcggttcagttcgataacgaatacactcttttcgtcagggctccagctgatattggtaaaataacggtcggtcgggtcacctgcctgtaaataagtggtcttgccatcttttacattgtatactcctacggtaaccttatggcttgtcatacctgccatcggatatttatcgggcaccagctcggcaatacgagtcgtcgtatttacttgtggataatcggtaaccatactttgatccatacggtaaaaagccagataagtacctttgggactccagaaagtacctttcatgataccaaactcattgcggtgtacagcttgtccatacacaacatccttttcaggttgctggttaccggtaacctttggatttaccatagtactgaaatccccttcatgtgctacatacaaatcattcccgatggtataggccatgtaaccattctctttacagaaatcaaagtttgtcggtccttctccctgcaacttgaacaggttgacaattttcttcttgccgaaatcataccataccatgtatttctgtgcgggagtgcaatcgtcatactgggtaaaagtgattatattgcggtctgcccatggcattgaagccgacattaatgtatggagcggtttaatatgtcctgtcagctgataaggcatttcgcctttaagggctttattgacctcttccaatgtagcaatgactgtttcttttccgcttttgttgtctatttttttgatatcctctatatctgtacgtacacacacgtctccccaccactgtaagcctggcagacttttcggcacaagattatagtaattgcttccacccggtatgacatcgttgagggtaaaagcctttttctcctgagcagatgagacagttgcaatcatacagaatagagctataatttgaaaaatccgtttcatctttttagttattcgttctctgtattttcttcattcgggcggcgacggtgcatgtaacgcggtgcaggtgcctgctttggacgtccgtcatcagttgacgggcgtgagggacggttctcacgagagaagttttctttacgttctgttgttcggaacgtaggctttctatcgcccttgtattccactctttctgcacgttttcgtggacgaacttcatttccttcccgtttgggcttgaattctttatcactgttttcgctacggaaagtcttgtatttaccgtcgaaaatctggtatttacggaactgacattccagtgagccgttgaataaaggtactttgactgatgccttcagaccaatttggtcgaagcattcgtcacggtagctcagtatccaggcatcattaccgcagaaggcgtgtttcaaacgttccccgatcatctggtacaatcccagcaaatcatccgatgaaatacgttcaccataaggaggattggttatgataatgcttttttctttaggctgttcgaattgctggaacggctggattttcaggatgacatccttgctcactccggcagcctttacattgtgtgtcgcaatttcgtttgctttcgggttgttatcgtatccgtaaatcttgtgtttaaattcgcgttcattcgaatcatcgttataaatggaatcaaacaaatcctgatcgaagtcacgccacttttcaaatccgaactctttgcggaatacacccggagcaatattgcgagcgattaaggctgcttcaataggaattgttccggaaccacacatcgggtcgattaagtcgcattcgcctctccatccggtcattagaatcataccagctgccaaaacttcatttagtggagcttctacttgttcctgacggtatccacggcggtgcaatgactcaccggaactatcgagtgaaagtgtgcagcgatcttctgcaatatggatattaatagccagatccggattgctgatacgtattgacggacgatttcctgtcttttcacggaaatagtctacaatagcatcttttactttatatgcaacaaatttcgaatgacggaattcattcgagaacacaactgcatcgacagcaaagctgctcatgttatccagataatcttcccaggcaatgcttttaacagcttcgtatacttcatcagctgtttttgcggtaaaatgcttgatgggtttcaggatgcggatagccgtgcgcaggcaaaagttagcacgatacatcattgctttgtcaccagtgaaggagaccattctgcgtccgatttcgatatttccggctcccagttcggtgagttcttgtgccagtacttcttccagcccctggaaggttttggcgattagctcgaattcttgattcattttaactaaattacgtaatttcaattatttgtgcaaaaatatgaattttcagtcagtcggtcaactgtttgaggaggtttaaatactttttgtgtccttctcgttgttcctttctcctgtttatgggtttgggacttgagtattcttatgccgtctttctctttatggaagttgcatattgatgtcttactattcaaaagaaaaaaatgtatctttgtggaattctgtatactttgtatggtttttatacaaaatggaggacaatatagccggaattttggaaatgtctggctaaaagattgagggtataggatttatgaatggactgagcgtgggaatgcatgcgtgtggatttcagataacggatgaggggattgtatagttttcgtcagtactcccttcttattggaaacgggtagtgatgactggattggacacgataaacagacttatataaaggaaaggtaagttgtatatgcatgagttagaagaattgctaattaaaaaactgcgtaaaggtgacgagcgagcatttcgtttgctttacgatcgtcactatgtgctattgtgccgttttgctaatcagttactgaataatgcggcattggcggaagaagtcgtagatgatgttatcttttatttatgggagcatcggcaggaagttgagattcgttattctatccgtgcttatttgatgcgtgccgtacgtaaccgttgtctgaatgaattacaattgcagagtcatcgtgaagaacttcatatctcttcttttttgtcgcctgaaagtatggattttctcgattccctttttgtcgataataagcaaccattagggatgcttttggaacaagagcttgaggaggaattaaaacggagtattgatgaattaccattggaatgtcgtaaggttttttataaaagtcgttttgaacagaaaaagtacgaagagattgctactgaacttggtatatcggtcaatactgttaaataccatataaaaaatgcgttggcttttcttcaaaggcgtttgggaagctatctgaaattacttattgtttatatttttatgaatagttgaaattttattaagtaataagtaagaataattctttagtagtaagtaattcattttgatcttgttttatagattaatcatacagccttttgtagaatttctcttgatgtttttttattttttgtacaaaaaataaaaagttttgtacaaaaaataaagggatcttttcatatctcattttttgataaagtcttttagctaattttttttgcatttatcaattaaaaacttgcatatctgactaccctttcaattatcttttttgtcttatttcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgttatttataaaaggcatttaataaaaatgaatacagaagaacataatgacatagatttactgatagttcaatatctttctggtgtgttggataaagaagcgttcgcacggttaaaacaatggacttttgcatcagaagagaatcgaatttatgtaaagaataaaatagagatttggttttctgctggtacagtgaatgaaacgtgtatgtttgataaggacaaagcatttcaattgttccaaaaacgtgtgaagaaagctcgacgttctaatgtacagatgtggaactactcatcgtggaaaaactgggtgcgtgtggcagcaatcattttaatattgttattgccatttatcggatattggggaggaaaggagtctgtgaaacaaacttttgccgatattgtggtagaagctccaatgggggcccgtactaaactatatcttccagatgggacattagtatggttgaatgctggttcaaagattgtatattcccaaggttttggagtggatgaccgccgcttgaaaatggaaggtgaagggtattttgaagtaactcataaccccgatattccgtttgaagtaaagacgaaggagattaatctgaaggtcttaggaacaaaatttaattttcgtaactatccggatgacgatgaggccattgtaaatcttatggaagggaaagtagctctacataatgaggtaaaatgcatgcctgaactttatttgatacctgatgaaaaaatgataatgaataaggtgacaggtgaaatgagaaaaacgaaggcgaaggccaaacgttctaacatgtggattaatgatgaattgttttttgatgaactgccccttaagcatattgcaaaacgtttggtgcgtagctatggagtggatataatagtggaagattctttgcaggataagcgtttttatggtgtatttaaggtacagggaaatacaataaaggatgtgcttgatgccatggcttctacaaatcaaatgaaatatcgttatgaacatgggaaatatatattatattaataatcaatatacatagtgatatgaaacagataagagcaagttaaaatgagattatcaatgaaataaacctttgtaatctatctaagtaaatcttatataaacttaaatctttaattatgaggaactttaataagactatatttgtagtctcggcagcgctttgcctaaatttatccgtcttttcgcaaaatgtttccttttctgttcagaatgttacggtcaaggaagcgatggagcaattgaaaaaatcatcaggttattcttttgtcttttcatcatcagatgtagacactagtaaaaaaatttcagtctcaggtcagaactcttccattcaggatattattaaacagattcttcaaggacagaatgaattggactatgaaattcaagggaaaaagattattgtaaaaaaaatcaaaagttcaaaccttgttgaaaaatcaaagaaaattttagcctctggtagagttttagatattaatggtgagccaataattggggctacggtattggaaaaaggtactactaatggaacaattacagattttgatggaaatttttctttagatgttcctctgaatattacgttggagatttcatatgttggttaccaaaatcagcaaataatagtacaaacagaaaaaccttatactattacattaaaagaagattcggaaactttagatgagattgttgttgttggttatggagtgcaaaagaagtcagatgtaacaggtgctgttggtagtgtaaatagtgatcatattctttcaaaaggatcaacttctgttatggaatcgttacaaggacaggttgcgggagtagatatttctcaaagttctagtagggcaggagaaggatttagtatatctattcgtggaaaaagttctatggcaggtggaaatcctctttatgtcatcgatggtgttgtgtgtgataacatggattttttgaatcctgcagatattgaaaaaattgatattttgaaagatgcatcctcaactgctatttatggttctcgtgcaacaaatggtgttgttatgataacaacgaaacaggcaggtactacagataaaagcaatacaaaagtccaagtgtcttatgatgggtattatggatataagactgtagctaatatgcctgattttatggatggggatgaatggacaaattatagatttcagcgttatacgacattaaaatctgttgatgagtttggacatccgacttatgagatgttggattctgagtggagagcattttggggaaataatagtccaaaaatgaaagaaatgtttttatcaaaggaatattatgattggcctgatttggtgacatcagacggacaacagcaaaatcattatattaatattgctggtaatgcgaaaaaaatttcttatcgtgtgagcttaggatatcaaaaagaagatggagtattaacgtgagttcgatataaagattaaaattatcagtttgaaaattaggaacatagcgataaaagcattaaatttatagtgtctaagtataacatttaagcgattaccactatgttctcagagtctaaagttacggagattttttgtatggcggatgatttttgcaaggaatttgccaaaacacaggaaaaatatatggttgaagaaaagaatcataagcatcggaacaagccgaaccggatgagtgatgcggaaatcatggtcatcttgatcctgttccactcgggaggcttcagatgtttcaagcattactacaaagaatatgtatgcaaacatctgacgcatctctttcccagacgtgtgtcctataaccgttttgtggaactggaaaaggaagtcctgttgcagctgaccattttcatcaaggaagtcctgttgggtacctgcaccggtatcagctttgtggattccaccccgctgcgtgtatgccggaaccaacgcatattgattcacaagacttttaagggtctcgccgaacgtggaaaatgctccatgggatggttcttcgggtttaagcttcacctgatcatcaacgataagggtgaaatcctcaatttcatgttcactccgggaaatgtggatgaccgtgaaccgctgaaacagacaaagttcctgaagaatataaaagggaaactctgtgcggacaaggggtatgtcgggcaaaccctgttcgagaacctgttccttaacggcatacagttgataaccaaagtgaagaacaacatgaagaactccctgatgaacgtggcggacaaaatcctgctgagaaaacgtgctttgattgaaacagtcaatgacgagttaaagaacatcgcccagattgaacactccagacaccgttccttcaataactttattgccaactcgctctctgccatagctgcatactgcttctttgaaaagaagcccgccattgacgtttgttttgtcaaagacggacaactcacgatgttttaatttatttcgaactcacgttacttttattttcaatatatcaaaaattatatcctttttatcaaaatcgctaatttgcagatgatgataaattacgatatttacttcctaaaattgtgaatggcatcttataatctattattctcattcccttaatgattgaatattatgaaaatcaaattgtctgtattaagtctttttataggtctatcgtctgtattattggctcaagaaaagttgatatctttacgtccaactttaaattctgatgatacgaaatcatgccctttttctcaacgagatacaagagtacgtgaatacgtgacgcctgtaaggatggtatggcaacagcataccgaacttatgacaggaaccgattttttgttccgtcagggtaacggacaaccggatttggtaaatgctaatatttgtatcctgcgttcccaaaatggagtaaagccctctatcttgcttgatttcggcaaggaaattcaggggggaattcaagttgttacgggtatgcctgcttccaaaaagccaataactgtgcgtatacgttttggagagtcggtgagtgaagcaatgtgtgaaattgatggaaagaatggggcgtcaaatgaccatgcgattcgtgatttcgaaatgaaattgccctggttaggagtagcagaatttggaaattcggggtttagatttgctcgtattgatttaatagatgataatgtagagttacatattaaagaaatcagggctatttctgtttatagagatataccttataaaggatcgttttgttctaatgatgaacgtctgaataaaatatggcagaccggtgcctatacggttcatttgaatatgcaagaatttctttgggatggcataaaaagagataggttggtatgggtgggcgatatgcatccggaagtaatgaccattagtagtgttttcggatataatgaagtggttcctaagagtttgaatgctatacgtgatgtgactcctttgcctaattggatgaatggcattagttcgtattcaatttggtggttgttgattcagcgagattggttctattatcagggagatagaaattatttgaactcacaaaaagactatatcgttggtctgataaggttcctgatgaattttgttgatgaaaaaggaggtgaaaagcttgatggaatgcgttttcttgattggccttcttccaatagtccggaatcaattcatgcgggattacaagcattattggtaatggcgatggatgcaagttatgagctatgtaacatcttaggagaaactgagctggcaaatgaggcagaaagattggcaaaaaaaatgagaaaggcggcgccagctgtgcgtaagcaatatttaaaatcgatgaaagacccttctgctccaggcgcaaaacaaggggctgcattgatggtattggcaaatctgatggatgcaaaagaagccgatcaacatattatttcagtcaatggagctcatggcttttcaaccttttatggatattatatgctgaaggctatggctaaagcaggagattacaagggagcattagatatcatacgtacttattggggggctatgttggatttaggtgccactactttctgggaggattttgacttaaattggctgcctaatgcagcaaggatagatgaaatagttccggaaggaaaaaatgatatccatcgagattttggggcttattgttatcagaaatttcgtcatagcttttgtcatggatgggcttcagggcctacttcttggttaagtgaatacgtattaggggtgcaggtagtagagccgggttgtaaggttattcgcatagttcctcatttaggtgatttgaaatgggtaaaaggaacttttcccacaccttatggtattatttccatcagtcatacattaagtgataatggtaaaattgtaactgaggttgatgctccttctgaggttttggttctacgtgaatgataaagggcgattatagaaaaatgtagtttcttcatggtaataattgggtgacaatgaaagcaaggcattatttatctttttgtttgataggattgtttttgaattttataagttgtaagtcggaactaggcaatgaagtgaccttgtcggaactggagacatctttcagaactgttccagactctgtaaagattggagtctattggtactggatatcgaataatatatctaaagaaggagttatcaaggatttgcaatcaatgaaggagataggtataaacagggcttttattggaaatgtaagtttgcctgaagttgcagaagggaatatcaaggttttgagtgatgaatggtggaatatagtacatacagcactaaagacagctacggatctgggtattgaaattggctttttcaatggtcctggatggagtcaatctggaggcccatggataacagacaatcaaagtatgaggtatcttgatgacgcttcggttagagttgagggaggacgtgatactgttattgtgttaccagaaataaaaaatggtcaagatgtaaaggtgttggcatatcctgttttagcagaatcacaggaaaagtggagttttactaaaaaagaaggagaagagattggtctacagttacgggctccagctcctaatatgcgctctttaatttttgaaacagacactccgattaaaagttttggaaagatttatgcaaaagaaggaaatactttccggttgcttaaaagttttgatattgatagaagcaatttcaatttaaatgttggctttgtacctgatgcccctcttgttatttctctacccgagaatcaggctgatgtatataagtttgaaatgagtggttctggtagtggtaattgtacggtagaactatcatcaaaaccttatgtcgaatattatgcggaaaaaacacttgcgaaaatgtttccaactccacttcctatgtggaaggattatttatgggaggaacaacctcttgtctccaataaagagcaggtattggaccctgaaaagattcttgatttgacgtcagatgtgaataagggtgttttaacatgtcatttacctaaaggccagtggaaagtcgtacgctatgctatgaaaacgactggagtaaccaatgctcctgctgctcctgaagctacaggtttggaagttgataagatgaatagcaagcatttggaatttcattttaatgcttttattggtgaaattttaaaacggataccagaagaggacagaaaatgttttaaagttactgtcatggatagttatgaaacgggtggaatgaactggaccgatgatatggaacagaaatttattgaaacgtatgggtacagtcctattccttatttacctgtgttgcatggagaggttgttggaagtcctgatatttcagatcgatttctttgggatttacgacgattgatagcggattgtgtttcctatgaatacgtgggagccctcagtaaattaagccataaacacggattgacaacttggttagagaattatgggcattggggatttcctggtgagtttttgcagtatgggggccagtcggatgaagttgcaggtgaattttggactacaggtgatcttggaaatattgaaaatagagctgcttcgtcgtgtgctcatatttatggaaagcgtaaagtttgggccgaatcttttactgtaggtggaggagattttacgcatgatccttatgaaatgaaacagcgtggtgaccgcttctttacggaaggcatcaatgccacattactacatgtttatattcatcaaccttacgaagatcgttttcctggcataaatgcttcctttggaagtgaatttaatcgtcataacacttggttcagtcagttagatttatttatagattacctgaagcgttgtaatatgatactacagagtggtaagtatgtagcagatattgcttatttcattggtgaagatactcctaaaatgacgggacctgttgatccggcagtacctaaagggtatgctttcgattatatcaatggagaggtactgttgaaatcagcttcggttaaagatggttatttggtactatcaagtggtatgaaatatcgaatacttatattaccagatttaaaaaccatgcgtccggagattttgcaaaaaataaaatcgtttgtacatgacggtttaatagtgttaggaaatgctccggatagatcacctagtctacaaaattatcctgatgcagatagagaagttcgttgtttggcaaaagaaatatggggagacaaacatgtgtcatcacgaaaatatggtaaaggtatggtatatggtcgtgaatgccatttggactctttattactgaagaatcatattttaccggatatgaagatagaagatgatgttcccgttctttttattcataggaagataactgatggtgatctttattttatttcaaatcaatcaagggaatctatcaagtttacttcagttttcagggtgaaaaatatgcagcctgaactttggaatcctgtgacgggtgagataaggtacttaccagaatatagttgttctgaaaaaggtacgactttagatttgcaattagatgatagtgagagtgcttttgttgtatttcgtcattctaagcgtactttcaatggaggtacaaataatcctgtcttacatgaagaattgaatattattggaccatggaatgtacattttaaatcgatagatggagtctcagaaaaaaatataaaaatggaccaattggatagttggactaatgcagaagataatgatattaaatatttttcgggtgtcgctacttacagaacgatatttcaagttgatagtattgcttcagaatctgtttatttagatttgggtaaagtaatggtgacggcaaaagtaaaattaaatggtaaatatgtgggaggagtatggacagctccttatcggttgctaataactgatgagatccaaaaaggtaagaatgttttggaggtagaggttgtaaataattgggtgaatcgaataattggagacttgaatttgcctgataataagcggagtacttgggctaatgtcattacatggcacccagattcggagttacagcaatctggattattggggcctgtaaggttggtgggtacgtctgaattacattttgtagaataaagtatgcatcttttattttatacttatgaagaataaattcttgttatctgctatattggtagttttttctgtgtcactttttgctcagatgcaaaaaaataaaggctatccgacggcaaatccggatttgcgttccgaatttgtaaatcctccaaaaggttatggaaatattcctttttattggtggagtggagatagactgaataaagaacgtctaaaagaacaattgaaaattttatcgcagtcggctacggatggtttttcggtaagttatatacataccgacccagaggttgattctgtttttaataaaaatggatatggcctttttggtagaacaagtccgggagatccagctgttttctcggaggattggtggaatatctggaattggtattctggggaatgcgctcaactgggattaggagtgggcttggatgattatacgatcggatggaatggaaacggttattatccggatgaattggatacgatgtctgtttttcagaattaccaagggaagctggttatcgactcatattcagtaaataagggtgaactatttacgtgtcggcttcctgagaggtttctttcggctgttacatggccgggaagaatagatctgtctggttatatccatggaaaagaattgaaatggaaggccccgcaaacggaaaattataagatttatgtaatccatacagagaatagctatgtattacatccgctgcatgggaaaaaattggttgatgtttattttgacaggttctatcataggatggattctttaagtcgggaggggatgaactatttctttcaagatgagctttcatatcctattaatatgttgtcatggtctgatgactttccacaagaatttcaaaggcggaaaggatatgatgtaataccttatctttctgcgttgaaagaatatataggggcagtaactcctaaaatcaggttggattatgcggatgtcttgatttctctggcagaagagcgttattttgaaccgatatatgaagtcaagaaaaatgattcgttagttggcattttgttaagtcttccctatcagttagatataactccttatatgaaagaaggaaataacaaaatggagatattggtttatagtacattagccaatcattatcagacaatacctacccccctatcgaggagatcctaaagcaggattgctggaaccggtaaatttattgattgaataattatgtttcctatttatcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgatttatgagaagaaagaagttgctattttatatattactgatagtatctgttagtaaaggagccgctttaacggattctataaaactttcagagtttgcatctccatcgatgaggtggcgtcctgtcccattgtggttttggaataatacagaagtaaaggaagatagtttgttggtacaacttgatagtattttgacaaaagattgttatggtggctgtgctattcttccttttggaaagtcgtttggtcctgcatatttgtcgaaggaatattttcgtttgtatggtaaggtgattaaggcgatcaaacaacggggagctaaaatgtcgctttatgatgaatatggatttccaagtggtagtatgggagctataaatggttcaggtgaaaccatattcaagaacaatcatccaggtaaaaccattaggcgtcttgataaagtggaatatgccactatatcggatacgttatttcattgtgaattgaacgttaaaggtactattatgtctgtcgttgccatggagatgcaaacaaaaaagatagtatctttgagagaaaaacttgttgggaatattcttacgtggaatgttcccccaaaaggagaatggaaagttatggcttttgtatgtgtagaagatggagatcctaatgtaaattatctgtctcctgaggcggttaagctttttgttcaggatactcatgaggcctattacaaaaactttcccgaggcatttggaagtgtgattactacgacattttttgatgaacctactatgtatcgtgctcaagggcgtatgtggactgatgattttaatgataagtttatgtttcgttttggattttcaccggaagtcctttaccccgcattgtggtatgatatcggtccgtatacagctgttgctcgtaattatttgtttggtatgcgtgcttctctttatgctgaagggttcatgaaaactattgatgattgggctgaagctcatggaattatttcgactgggcatcaggatcaggaggaggttgttaatccggtaagtgtttctggcgatcttatgcttgacgggaaatatatgggaatgcctggtattgacaaaattgggggaaatcgacctgctgaagatttttataaagttgtatcttcatcagcaaataattgggataagacttatgtgatgtcggaaacttatggtgatatgggaaatatatctatagaacgtatgtacaatattgctatagaacaatatacaaaaggaattaatcagcttatacctcatgctgtttggtataataatgccgatgtgtggttccttccggaactctcttatcgtaattcacgatataattctctgcttgctgattttaatagattcctttcacgtctaaactatatgttggcacgtacaggacgtcatgtggctgatgtcgcaatgatatatcctatcaataccttacaagctggtcattattttgatggcccagaaggtttttacaaaggtggagtgaatataccagatgtcgattataatatggtatcacgtatgcttactgataatcttggcattgattttacttatattcatcctgaagtaatggacgaccgttgctctgttgatcatcaacgtttggtgatgaagaataagattaatacggaatcgttttctgttattatactacccagttgtagagtgataacattaagtaatatgaaaaaaatagaaaaggcatgggaaaatggtgtaaaggttatttttacgacacaattacctcaacaggttgccgatggagatggaacagatgatgatattacagccattgtcaaccggatgctcgtatcggagcgaaataaaggttatgctgtgtttgtgaaaaatccaaatgatgaagctctccgtaatgctcttatgacggtaaaccttgatgttcggttcagtgatgctgaacatccgttcaactatatacataaagtcatttcggggagtaatttatattatattgggaatatagacgatatggtcatagaaaataagattatactcagagggaaattaactgaatgtactttgttggatccacgaactggtaagattgaaccggcggctgtcagctatgataatggaaattcagtaataactcttaatcttgcacccggacagtctgtttttttagtcgaaaatactattttcggagaggtctcacagatgtataatactatgccttttgcttttaatgttcgctgcttacggtgaatatactaagattgatatctattaattaaatatattacatgatgaagataaaatatcctttattgtttgggttgattttattaaaatcgacttttgttgctgtctctcaggagcaatgtgtaccaatagggatgctctgcgagtatttaaacaatcctttaggtattgatgtattacatccacggttacaatggcatttagatgatgtaagggagggagcaaagcaggaagcttatagagtttttgtcagtacagactctgtaaagttggctgataaaaattatgcggattgctgggatactggtaaaaaggaaactgaagcaatgcagttggtatatgatggcaaacaattgataccgttcacaaaatacttttggaaagttgaagtgtgggataaagatggaaataaaacgacttctgatatcgctaactttgaaacgggcatgatggaaatgaagaattggagaggatcttggattagcgatggccgagatatggattatcagcctgctccttatttccggaaagagtttacggtaggtaagcgcatacaatctgccagggcatacattgctgttgctggattatatgaactttatgtgaatggacagaggattggggatcatcggcttgatccaatgtatacacgttttgacagaagaaatttgtatgtgacatatgatgtcacgaagcttatacagagtgggaagaatgccattggtgtcttattgggaaacggatggtataatcatcagtcgattgctgtatgggatttccatcgtgctccttggagaaatcgtcctacattttgtatggatctgcatatcgtgtatgcggatggaacaaaagaggttatttgtacggaccgtgactggcgtaccaaggaaggagctttattgttcaacagtatttatactggagagcattatgatgcacaaatggaattgaagggttggaaccttccgggatatgacgattcagaatggagagaatcatcttaccgtagtataccatcggctcatttagtttcacagcaattacggcctatacgtgctgttgaaacgtacgcagcgcgtcgaatgacttgtctatctgattcgatttatgtatttgattttgggcaaaatatgtcgggagttacatcacttcgagtttctgggcagaaaggaactgttatttatttaaaacatggtgaaagactttatcctaatggaagggtaaatacttcaaacatagatgtatatcatcgtccaatagataactcagatccttttcagacagatatcgtaaccttgaaaggggagggccaggaggaatttatgccgaagtttaattataaaggatttcgttatgtagaagtaacgagcagtcgaccgattaagttgaatgagcaaagcctgacagcctattttattcatagcgatgttccacaagtagggtttatacaatcttccgatacaatcattaatcgtttatggagagctacaaataaagcatatctctcaaatttaatgggatatcctactgattgccctcaaagggaaaaaaatggttggacaggagatgcacattttgccattgaaactgctttatataactacgatggcataactgtatatgagaaatggcttgccgatcatcgggatgaacagcaacctaacggagttcttccggatatcattcctactggaggatggggatatggcaccgacaatggacttgactggacaagtactattgctattattccttggaatttatatttattttatggcgaccttaagcctttgacggattgttacgatgctataaaaaaatatgttgattatgcagagcgaaaaagtgttggccggttaacagactggggacgaggtgattgggttcctgttaagtcgcattcatcgaaggagttaacgtcttctacttatttttatgtcgatgccaaaatattgtctgaaacagcaaaattgctaggtaaggaagatgattatctttattattcaaaattggctgaggaaataaaacaggctattaatgctaaatatttaaactatgaaacaggtgtttacgctagtggcactcaaacggaactaagtgtacctcttatgtggggagtgactccagaaaatatgaaacgtaaagtggcacataatttagcatgtaaggttaaagaatgtggatttcatttggatgtaggtgtactaggagccaaagccttgctgaatgctttaagtgaaaatggggaggctgaaacggcctataggttagccgtgcaggatacttatccttcgtggggaaactgggttgctaatggagcaacgactttgcttgaaaattgggatttaaatgctacccgtgatatttcggataatcatatgatgtttggtgagattggaggatggctatataaaggcttaggaggtatttatcctgatagtaaattccccggttttaaacatattatactaaagccatatattccaaaagaattaaagcaatttgaagcgacccataattcaccttatggaaaaatatattcaggttggagtcaagtgggtaataaggttatatacaaagtaattgtccctcctaattctactgcaaccttgttcctgcccgataatgtatctgatagtaataaaagaatggaattgaagtctggaacctatagttttgatttgaactttatcaagtaggcggttgtaaatagctttcagagataaaatttaacttatagaaatttttcgggaaaataatgcgaattggtgatcttttgacaaccaattcgcatttatattttatccctcaataaatgaatgtaattcttcttagagaaatttttattgtacgttggtaaatatgaaaaaggttattccctacgttgtacgatgcgtgctccggccggtacactttccgttacccagatattaccaccgattgttgcacctttccctatggtgatacgtcctaaaatagttgcattagagtatacgataacgtcatcttccagaatcggatgacgagcaattccctttatcggatttccattttcatcgagcggaaaacttttggctcctaatgttactccttgataaagtttcacattatttccgatgatacatgtggcaccgattacgacacctgtaccgtggtcgatggtaaaatgatgtccaatctgtgctcccgggtgaatatcaattcctgtttccgaatgagccatttcagtaataatacgaggaatgaggggaacattcagcatatacagttcatgagctatgcggtaattggtaattgcacgaataataggatagcaacagatgatttctccaaagcaagtggctgccggatcaccataataggctgcttctacatctgtagcgagaatacgtcgtatctcaggaagtttgctgataaagcgtgctgcgatggaagcggccgtatctcggtcgggaattttcttgatggtgttttccgaaggattattttccagtccgaaacacaaacctgcttgtatttgttctgtcagcaaaccaaatacttcttctacattgactccaatgtgataattgattgttctccggtgaacggtggaatttccaaaatagccggggaatagaatctcgcgggctaattcgacgatgcggcggagtgatttccctgacggaagtggatcgccgtctttgtattggtgaaacaaaccttcgtatgaacgattgtcagatagttcgcttactgcttgcgtcagggtatgtgtgtaatcggatatactcataatactttgttttagtttgaaaaacaaagttagttattttcaataagtaaaataggagagaggactgttttcctcttcctgtatcgattataattgtatttttgcaaaaaaatacagataatatggtagtgaataagaaaaatccttttgcctggaaagccaagcagtcgggaaagaaaaagacaagtggtaaacgtgtaggcaaatcgaagcctgaaaaggcaaataatcagctgaatagaagagtaaaataattcttcttcattcagttgagcaaatgataccacctcctaaaactacgtcattccgataaaaagcggcagcttgtccggctgcaatggcggccagcggttcatgcaacctgatgtataggcgtccgtcaggagtaggagtaacagtacagcggttggcttgtttacggtagcgtattttgacgatgatgtcatcggtcgtttcaaacaaggcagctggattcgtcacatgccagtcggtgagatacatttctgtctgttccagcgagcggagtgtgtcgctgatgatgacactgttggtttgtggaataatctgttttacaaatagtgctttattcaggtaaattcctaatcctctgcgttgtccgatagtataaaagggatatccttcgtgtttccctaagcaattaccgcattcgtcataaaagttgccgggcacaatgagatccttttctacgtgttcttttagaaaactccggtagtccatggggcaaaaacagactcccagactgtcatgtttatgagcggctttcaggtgtccccgttcggcggcaatcctacgtacttcccttttagtcagtgcccccataggcagtagcatgcgttccagtatgtcttgtggaattccccacaaaaagaatgactgatctttgtcgctgtcggctccagcggtaatatgccagtatccgtcgatgttccgtttctgtacgtaatggccggttgcaaaataataaatgcccctttcatcagccaattgtttcagcaatggccatttcaggtaattattgcaaagtgtacagggtacaggagtgcgtcctgccatgtattcattgataaagtaggaaataatttgttggcggaatttctcccgtacatcatgggttatatggggaatatttaaccgttcacataattcacgggcatcgtccagatattctgtattgttatctttttcatagaaacggaaagttacgccggttacttcgtagccggcatcttgcaggagcaacgcagcgaccgaactgtctgttcctccgctcatacctaacaggactttcttgttttcttgcatattattttacgtatgggcataaaaaaaggagtaccgctgtactccaacctttgttaaccttaaatctaatactatgaaaaacacgatgcaaaggtacggacttttgggaaatctgcaaatattacagctaaaaaactatgttttataacatgatttaagaattcgccttgttgttctatgtttgttaactaaaagatttacatcttttcttgacgagtgtacactgttttctatttttggtaagctaagctggcggcttttcgagaaaaaaaagaccctctgtttccttattatttcttttttccgtacttttgtgacttaactaaaagagataattatggaaaataagctgactatttataatacgcttacccgtcgcaaggaactgtttgttccgttgcatgctcctcatgtaggcatgtatgtgtgcgggcctactgtttatggtgatgctcatttgggacatgctcgtccggctattacattcgatattcttttccgttaccttacgcatctgggctataaggtacgttatgtacgaaacattaccgatgtaggtcatttggaacatgatgctgatgacggtgaagataaaattgcaaagaaagctcgtctggaacaattggagccgatggaagttgttcagtattacctgaaccgctatcataaggctatggaggcgttgaacgtgcttcctcccagcattgaaccgcatgcatcgggacatatcatcgaacagattcagttggtgaaagagatcttgaagaacggatatgcttacgaaagccagggttctgtttactttgatgtggcgaaatataacaaagatcatcattacggaaagctctccggacgtaatctggatgatgttatcaatacaacccgtgagctggacggacagcaggaaaaacataatccggccgattttgctctctggaaatgtgcacagccggaacatatcatgcgctggccttcaccgtggagcgatggtttcccgggctggcattgcgaatgtactgcgatgggacgcaaatatctgggtgaaacgttcgatattcacggaggtggcatggacttgattttcccgcatcatgaatgtgaaattgcccagagtgtagcttcacagggacacgatatggtacgttattggatgcataacaacatgattaccatcaacggccagaagatgggtaagtcactgggtaacttcattacgcttgatgagttctttaccggatcgaacaaactgcttgctcaggcttattcaccgatgacgattcgtttcttcatccttcaggcacattaccgcagtacggtagatttcagcaatgaggctcttcaggctgctgaaaaaggcttggaacgtctgatggaaggagtcaagaatctggaacgtattactccttcgaaggcgaccacaggtattgaaccggccggattgcgtgaaaaatgctatgaagctatgaacgatgacctgaatacaccgattgtgatttctcatttgttcgatgctatccgtatgattaataccgtaatcgacaagaaagcaactatcagtgccgatgatcttgctgaattgaagagtgtattccatacatttgtattcgatatcctcggtttgaaggctgaggctgaaaacaatgctgcacgtgaagaagcgtttggcaaagtggtagatatgctgcttgaacagcgtatgcaggcaaaggctaataaagactgggcaactagtgacaagattcgtgatacattggctgccttgggatttgaagtaaaagatacaaaagatggatttacctggaagctgaataaataaaggttcatctttttacagataaataaacgcggatttgtgcagatataattgcatgaatccgcgtttgtttgtattaccacatcgattataaataaatttaattgcttttttcccttcacatgtttttcggaaggagataaaagctatttcgtattacgactgtataaagacaagcttatgtaagatgcaggatgtgtgaagggtaaaaaggcatgaaaaattaagaaaaacgacgtgtttggagagatttctctcgatgtttttggaagatttatacaaattccaaaatgttttgtacaaaaaataattctctattcccgatgtgcagacagtaacctgccggaagttaaacgaaaagctcgctacgaatgatgcggtatattgcagcctgtcatcattcatagcgagcttatgttgtatcctttcgtctgatagatttatttcacgatggaagtgagcggatgtctgttgcctttgatatcggtaaggaatgcctttgccgacccgaagttcagatacatatccagtcggaccggtaaatgattgcggtcgtcggttacataaaatgtaatcacctctttttccttgttgtttacgtattccacgagcgagaaaaccagacaacggtatgttactccttgttcggaggtaaaattttcctttcctctataaatcagtgtctgcttttcgacggcacgtcctgttgccatagagaataatatttttattcccggtttgtagtcggacggatcgtacgaacgggcttgcagcaagatactcagcatatcgtagacacataccggcatttcgtcgtgtcttttatctgtcttgccatacaatgtacgttgctgatcgacgatacatttcccgtttttgtaactgaaatgtacttcatctaccgtatagcgcttaccttcttcagctccctttcggaaatataacggttccagctgctgactagtaatacacgtcagcgtgtcacgcatcttgaagaagaagtctatcttcttgttcgtgtacgattgcaaatcggttctcaggcaaggctggcctttatgagtcgtttcgttgactgtcattttagcccatccggcattgatccagatgaacttccagttaaatttcagttcataactcaatgtttctcccggtttaattgcatcgttttcagctccgcattgtgcgttggctgccatacctcccatcaggaggcacaggcatagaaatattttctttatcatgaccttcctagatttttggctcgttctttattcctatcttttattttcttggtttcgtcgggtttttgcttctttatttcgtccagcttttgcttgttgagcggggtagcatgtatgtcccacgtttcctcaaattcgaagttggctttcatttcccagactttcgggaagtagaagacctcctctgcctgacgtttgtcttcgtaaaggccggtatcccattttccgttattgttatcatcgttgatgaggcggatgtaatatttcgtgctgggctgcaagaaatagaaatcgcacgtcttcttttcagtaacgggctgttgccgtactacctcatcgctgctgttcagaagctgtacgatagcatgaggccctgctcctacaatattcaggtaaagagtaccgtagtcttccagtgtttttaccttcagggtattttctatcttgtcggaagataatccatagattcctttaaagcaaagagaatcgattgtcattttatattctacgcccggttgccagtttgccagtatctcatagcgtcggtgggcaacactgtctgcctggaaaataaaaggaatatcctgccatacagagtctaccattgtactcatgtgaatggctgcggtatcgatactctccaatggctcctcgaagttcagtacgacgtttttgttcaagtcgagtgaggaaggagcatccacattcaccttcaggaactgagtctctaccgttagcgtatctccttttcgctcccgttttttacgttccttttctttcttcttatcttcatcagccttcattgccagacgtctggctttcggaatcttattaatcatacgcaacgtatcggttttaggaaccaattgtcccaatgtatccgttgccagataatccagttgcatggtcagcgtatcgcgttcgcatagagtggtatcctttatccagtatagaatactatccttgcgtgagtttgcttcaacgataagttccttttcatcgaagtcgagtcccttcaatgtaggcagtgtatctgccttggcactaaaataaagtgcaaactgcgttgttttaggtcgttcgctcttcatcagatactggaggctgttttcttccttgaaagcccgcaggatgatgttatcgggcatgaaccttgtgtagttgacttgtttgatggtatcgattttcgtcgtatcgagctcgttccataccgtatcctgacggacagctccctccatgctgggcacaatcagcgaatcctgaaaggcgattgcttctgttttggagtcgaacaggtaattctggtttccgtccatcaaggcatagatgcgataactgcccggagcaatacctcggatcgtgaattgcccgcggctgtctgtacgtgaaatacggtcgaacggcagtttggtgaaagccgaatcgttcaggttcttgtgcaatccaacttgaattcccttgatcggctccagattttccgcatttagaacggtacccgatacctgcatcgtgtcaatgttagaaccggtagaaaaagcgtatgcaaactgtcctaacggatttccctcgttgttgtcgacaatggcatcaccaaagtcgatggtatacgttgtattttcctgtagcgtatcgaagaattccactagtacccttctgccactggtctttacctcaggactttccttttggggaggagaaataatcaccttttcggaagcattttccagcttgatgaattcatcgaactcgatggagattttcttgcgcgtattgttggtcgcattcggttcgggagtagcacgtacgaacttgggcggttcctcgtcgtaaggtcctccgtctggtgatccggtacttgcacacgcgtagaatccgatgattaccaataatatggctatgtatttagggattggcttcatatgtttaattttagcatttcttctatatagtcacgattgttgctcaggcgtggaactttatgctgtcctcccagtttccccttttgtttcagccagtcgtggaacaagttagggcgtgcaacgataatttccagttcctgtaatgtgatatccttatgtcgtttggcctcgtagtcggaattgatttcctgcaatgctttgtcgagggtatgtcggaacttttccagtgaatcgggcatgacactgaattctatcagccactgatggcggcatttggcgttggcatccatgaatacaggtgctgccgaatactccagtacctgagctcccgtttcggcacaagcacgtgccagtcccttttcggcgttatccaccatcagttcttcaccgaacgcattaatgaagtgtttggttcgtccggttatgataaacttatacgggtctttttgcgtaaacttcacagtatcaccgatgatgtatctccacaatccgcaggaagtactgatgaccattgcatagttcttgccgatttcaactccagacaaaggaacgatggcaggagccggattgtctatttcttccagcgggataaattcgtagaagacatcgtagtctatcatcagcagcatggcaggatcattcaggtcactttgcaggccgaagaaaccttcactggcattatatgtttccatatagtgcatcttgtcgcttgttatcagttgtttatattgctcgcggtaaggagtgaaacatacacctccgtggaagaatacttccagattaggccatacttcattcagatgtttggcacctgttttttccaatatacgtttgatgacggcaagcatccacgatggtactcccgaaaggttggtcacgttttcgtgaatagtcgtttcggcaatgcgttctaccttttcctcaaattcgctcagcaaggcaatttctttgctggggacacggatgaagttcaccagcggattgatattttgtatcaaaatagccgataagtcgcctaccagactgtctttcaggttgtagttggggctatggcttccgcccagtatcagtcccttacccgaaaagaatttactttgaggattagaacggagatagagagctaccgcatcggttccgccttgataatgaatatgatgcaatccatctttgctcaccgggatgaatttgcttttatcgttggttgttcccgacgatttggcgtaccacactacttgtccgggccataaaatattcttttctccgtggcgcatacggtccacgtaaccttttatatcgtcgtattgttggataggaacatgcttgaaatcatcgtatgtgcgtatattggcataattgtattttgttccccattccgtagcagcggcggtttgtataagtttccggaacacttgttcctggatagcctctgcttgttttgcatacaggtctatttctttctggcgcgaaacaaacagtttcccgattaactttgttgaaaccatttactttttcctttttcttaatctattcttacatgcaaagttaggtgatttcttcttcaatgaaatatttttccttagagaaagcacaaatctacacttttttcttataactttaccacaagtagtgaaaatttaaaggttatgcgaattggaatcttaacatctggaggtgattgcccgggtataaacgcaactatcagaggtgtttgtaaaacggcaatcagtcattatggaatggaagtctatggaatacacagtggttttcgtgggttacttgacgatgatgtcgttccattggatgaaaactctctcacaggtctgttgagtatgggaggaactattttgggtacatctcgtgaaaagccttttaaaagtaggccgaattcacctgtatccgaggataagcctgccatgatgttgaaaactattcgtgaccgtcggctggattgcgtggtgtgtataggtggaaacggtacacaaaaaacggcggcaaaactggcggcgacaggagtaaatgtggtgacagttcccaaaaccatcgataacgacgtatgggggaccgatatttctttcggtttcgattctgctgtaagcatcgctactgatgcgatagatcgtctgcattctacggcaagtgcccatcagcgcgtaatggttatcgaggttatgggacacaaagccggttggattgcgttgtattccggcatggcaggcggtggcgatattattctgttgcccgaaataccttttgatattcatcgtattggtgatgcaattatcaatcgtctgaaaaaaggaaaaccttattccattgtggtggtagcagaaggtattcctactttgggaggaaagaaagctgcacaatatattgccgaggaaatagaatacgaaactggctttgaaactcgtgaaacggtattgggatatattcagcgaggaggggcgccgactgctttcgaccgtaatctggctacgcgtatgggaggtcacgctacggaattgatagctaatggacagttcggacgtatggtttccttgcaagggtcggaaataacttctgtccctctgtcggaagtagctggtaaattgaaattagtcacagctgatcatgatttggttgtacaaggacgtaggatgggaatctgttttggatgaattgtgtattattccccagtgttgtataaggggtgtaaaagcgtctgtgtgagggctctatagaatttgttataaacttgcactggaggtcatgttgtgatttgcatgtatctttgtacggctgaatgtgaatcagtcatgaagaaagcattggtttgtgtaattgtttccttattattgttttttattggtgataaggtatgtttcaatctcgcatcaatcgtagtcttattatattgatggaataatgaataaaatcaagaaaaacacttatccttttaaatggagtcaattgaatttgctgggaggatgtattcttatcttgttgggaaatttttcttgtagttatagggctcaagaaaaggaaaagagcttagaggatagaagggttatccaacaacaagtagagccgcaagttcttttcccttatcctgaaattcccgctatgctgatacggccggatgagcgtgagacttatctggtggtgcattattgggataattttaattttgcagatacactattgataaataacaaagatgtgacagaacaaggtgtagctgattatcttgctatacttggaaagggaacagtaaagggagaagatttgaaagaaagtttggagaatttctgtaatagattggagcaacaagctcatgcgcgaaaagtattgttacagataatggaaaattatttatataatcccaattctccattttataatgagaaattatatgctttgtttctggaacgcatgataaatagtaagtacgtcgatgcagtaagaaagagttctcttcagtttcgtttacaattaattaagcggaatgctccagcccataaggctactgattttgtgtattatcttccggatggtagtaagtgtacattgtatcaaacaaagattaggggtaatcgtctgctattggtcttttatgaccctgaatgttcaagttgccatgaagtcatgcaggaaatggtacgtgataatttgttgaagcaagctgttgaaactgggtatcttactgtcttggcgatatacacagaaggaaatttggaagtgtggaaacacactcttgacaaactgcctgaagagtggattgttggttgtgatcgtgaagtaattagggatattcagtaaatgtccccaaaataagatggcatatgaaatgattatggtctatcatcttcatatgccattttttattgtcatttttccatgtattctcacataattctatccgtcaggacatgacacttctgaagaagccagatgacctcttccgattccgtcagtaaaatcatatcatgccgctttaaccgtcctgttcctgatcttgtcaatcatcagtacggcatttgccgtatgtattccgaagaaaatccacaggatttccgtcttcctgttccgtgcctttatcctggagagcgagtaatgctgcttctgtgtaccgaagcttccttcaagccgggtggccctctctttggagagttcacttctgagaaccttcctcaaggattcatccctggccgcccttcccttgcgtacgaaggaagtggagattccgtatttcgtgcagaactttctgttggcgttattggcatatatggaatcggctgctacgcatcttaccctcacgttcatgagcttctgctgcatgcggatgcagtccttcaggcatatcccctcgttgaaagccttgaacgagaggtgttcgatgaacgatatgccgtctatctgtatgttgtttaccttcgcaccgaactcaacggatttcgtttccttgcctctgacgatgggatgcacataatgacggtcaatgctgacgatgcgctcactgacttttcgtccttcaaacatttgcttttcctgtacaagaacctttctgatgatggaaagccgcttccggtaatcctgagtataccggagtgaggctccatactctttgtgaattccatcccgctgcatgagaagtttttcaaggagtctgatcatacgtcgcttgagcatccttgtccttgatgcctttctctttcttttcttacagtaggacagataagccttggcaatatcatcatatttgttgcggggacgtcttatgccaagttccccgcaatgcttgcagatatgcctgtagagccattcgaggctttcccaaaggagcttcatgtctgtagggaaacgcatatggctctcatagcaggtggcatcggtcatgcacacgtgaaggttctcaagatacggcttccagtgtgaggccagcacttcctggagggattcaatgtcaagacgggatgccatctcattgcggatggcactgactatcttgtagttggttatggggaaggacgggtctatcatgattccgcagaacatctgatagtgtatgttgctgttcagatgttccaccagctgtctgtcggagaatccggtgtatgccttcaggaccatgagggcaatctttgccgcagggctgaagatgttcctgcgtcccagtcgctgttccaacaggcccaaggcttttgccatacgctcaaacggaaacaccgagtgaagcctgccaagctcactctcgttaaaactcttgcggtatttttccagaatatcaaattctgtaaagcccaaagtaggctgaatttctgaaatattttgtacttttgccatatcttggttggggaatttcccccgttttggctgccaaaccttatttgcgggggaatacctaaagatacaaaaaagccagctaattcgcaacactttgtgtatgaattagttggctaattttatattatttactgaatgtccctaattaaagaacacactttatatgatttgaaagctatgccttcgctttatttacttgatgcagacaagatagttttgttgaaagatgcctcttataacaaaatatgtagggagttacaagattaggctcaacccagtagaataaaaaccaaagtcggaagtatataatgtacttccgactttggtttttattctactgggtattccccggatgaaaagcagcttcttcagcttctgcaatgatgcgttctgtatcttcgaaatattcttccggcatttcagttttccggatgtttacttcttctgtcagtactacgctttctttctgtgcggtagctgttaccttttcttgttcgcttgcttcctgagccttttctcgttctgactttgctgcgaagatagcatcgataaattgcggatcattctttatcttggctaacgtttcgtgtgcagcttcctgttgcgattctttcttggaatatcctttacctgtaccagctgcaatattttctactgtgacctgtgtttcgaaaatcggattttgagcctcgtcgaccgattgtcctgtcaagttaaattcaatattgaatttgtttttctggctccattctatcagcttcgacttgaaattgacctccttacgggaaatcttttccagattcaggtactggttgattattcgttcttccatgaatttcttgcaagcgcgatatcctctatccagatatatagctccgataagagcttcgaaggcgtttccacacatgtaactgttgtgtgaagactgtttagtagtatactttatcagcttatccagtcctatctgtacggctacgcggttcaaggtttctcgttgtacgatcttggaacgcgtattcgtcaggaaaccttctcgtttaccttcgaatttcttgtatacgatatcggctactacggcatccagaatggcatcgcccagaaactcaagtcgttcgttgttcagtaatcgtccttttccagattttatagacgatgatttgtgtaacaaagcttgctggtagatttcgatattcctcggatagaacccgagcattttgtaaaaacaaagataaggctccttatccttacggaaaagaagtcttatcttatctgttatattgctaaacacagtttattcagtgtatttttttacgattacacatgcattgtgtccaccaaaaccgaatgtattgctcaatgctgcacggacagtacgttgctgtgccttattgaatgtgaagttcaggttataatcgatttgttcatcattatcaccttcttcgtggttgatagttggaggtacaatgtcatttttaacagaaagtacacatgcaatagcttctacgccaccagtagctcccaagaggtgtccggtcattgatttggtagaactgatattcagtttgtaagcgtgctcgccgaacaagtctttaattgcctttacttcagaaatatcacctaccggagtagaagttccgtgtacattgatatagtcaatgtcttccggtttcataccagcgtcttccaaagcgctcttcataaccagtttcgcacccagaccttcaggatgagaagctgtcagatgataagcgtcgccagaagcacctgtaccggccaactctgcgtatatcttagcaccacgtgcttttgcatgttccagttcttcaagaatcagacatccggcaccttcacccattacgaatccgtcgcggcttgcactgaatggacgtgaagcatgtacagggtcatcattgcgagtagacaatgcgtgcattgcattaaaaccgcctactcctgcagggaaaatggctgcttcggcaccaccagttacgataatgttagcttttcccaagcggatatagttgaaagcatcagctatcgcgttggaagaagaagcacacgcagaagtggttgtaaagttagggccatggaaaccatacatgatagaaatctgtccggatgcaatatctgcaatcattttcgggataaagaacgggttgaatttcggtccgatagtatctttggttttttcataaccagcaacttcttcttcgaaagtatgaatacctccgattccgacaccgagaattactccgactttgtccaaatcttctgtttcgacgtctatgcctgcatctgttaccgcctctttagctgctacgactgcatattgagtataaaggtccattttacgggcttctttacggtcaataaaatcggtagcattgaagttcttcacttcacaagcgaactgagtcttgaacttagaagcgtcgaaatgagtaataggtcctgccccacttactccattaagaaggttgttccagaattcaggaacagtattacctaccggagtgagtgcaccaagacctgttaccactactctttttaattccataaaagtagaattaaattattttgcgttagcttcgatgtaagagatagcgtcgcctacagtctggatcttttctgcctgatcatcaggaatagagataccgaattctttttcgaattccataatcaattctactgtatccaaagagtcagcacccaggtcgttagtgaagctagctgtcggagttacttctgattcttctacgcccaatttatcaacgataattttctgtacttttgatgcgatttcagacataattttcttgttttaagtttataaatagaataattttgtttatatttcggtgcaaaggaataaatatttctcgttctatacaaatattcagccaaataaatgcagtttctttgcacaattttatatattatgtgcacaaaaaagatgaattaatgaaaaaaatagcaattttggcatcgggtgaaggtacgaatgccgagcgtattatccgctattttaccggacatgcgacgatagaagtggccgttgtaatagcttcccgtcctacagctcatgtgatagagcgtgctcataccctgaatgttccgtgtgaagtaatcattccccaagattttgcggcaggcaaaggacttgaagtgttgataagttatggtattgattttgtggtgctggcaggtttcctgtcgcgtattccggatgatgtgctgcatgattatgcacgcagaatagtaaatatacatccttctcttctcccaaagtttggaggcaaaggcatgtacggcatgcatgtacatgaagcggtgctggcagccggcgagcatgaaagcggcattaccatccagtacatcaacgaacattatgatgaaggtgatatcatttttcaggcgaaatgtcctgtcttgcctggtgatacacctgaaacccttgcacagcgtgtacatgcattagagtatacttattatcctcaagaaatagaacgtttgctttcactcctttcgtaggtgatattcactacgcagctgttcgaaagcttctggatgagcgcgcaatgcctcacagtctatgtgtggattatacatttgtaactggcggatattctcgtccctgtcgtagggtaaatgcggttcttcggaaggaacgatagagaaattcatttctttcctgaagaaacgacaaaaggattccagtaccatgcgggtagcattggctttcccgtctgccgagtatccggcaatgtgcggagtgccgataaataccttgtttaatagctcaagattaatgttcggctcgttttcccagacatcaagtacggcccccgatatttttccggcagacaaagcattcagaatggatgaagtttcgatgacttctccgcgggacgtattaataatgtagggttgcttttccaacagacggaagaaaccctcgtcggcgagatggaaagtccgatacttcccttctcgttccagtggggtatggaaactgataatatcacattcgtgtgccagtgtacgtaagtcgacaaatcctttttctccgcggtcggcacggggaggatcatttaataaaacacgcatacctaagcgttccgccagttgaccgatgcgacttcctacatgtcctactccgacaatacccaagcaggcacctttcagtgcgatacctttttcctgttgtagcaataaaagtaccgagtgtatatattgttctacggcccctgcattacagcccggacaattactccacgtaatacccgcttcgtgacaataagccgtatcgatatgatcgaatccaatggtagctgttccgatgaactttactttacttcctgccagtaagttacggtcgcaacgggtacgtgtacgagtaatcagcgcatcggcatcttttacaatttcgggagtaaatgcctttcctggcagatagaccacttcatcggcaagcgattcgatagcttcctttatataaggaattttattgtcaacgataactttcatgtctgtttttctaaaatcgtgcaaaggtagtattttttagatttataattggatgaaatgaaatctttatgtagatttgaaaaatgtaggtattttgttacctttgtacgctaataatgatgtttatatgaaatgtttgcatatcataactccagtaaaagattcgattgatttcactctcgaaacagttcgtgccattttagcctccgacattaaagttccttttacctatacggtatacaatgatttcagtacagaagaaaataccaaacgtctggaggaagcctctaaagaattgaattttcgtctggtgaacttatccgacattactacccatccttctccgaactacctgctggtacttcaacgctcacagcaagaggctattgccgctgatgcgggattactcattgtcgagtcggatgtggttgtcaaaaagaatacgttacaggatttgtacgatggagcagctgcacgtagtgggtgcgccattgcagcagctgtaactgtagacgagaatggagttatcaattatccatacctgcatgccaaaggcaatgaaggcaaggtgtatccggaaaagaagcattgcagcttctgctgttcactgcttacgccggagttccttcgtgctttcgacttccgtcagcttgatccgacaaagaactggtttgatgtaaccatttcacatgaagccctgaaacaaggttttcagaactacctgtttaccacccttcctgtctggcaccgtccgcacggaagccgtccgtggaaacagttgaaatataaaaaccccttgaaatattattggttgaaatatacgaaaggactcgataagatttaatgattgcagatatggataaaactcctttggtttcggtggtagtgcctgtatataatatggagtcttttctgccggaaacactcgattctatattggcgtctgattatccgaactttgaagtagtagtggtagacgacggttcgaaagacgcttcgtatcgtgtcgcatgcgactatgcaaagaaagatcggcgtgtacgtgcctatacccaacctaacgggggagcttgtgcagccagaaatcaggctgtccgtctggcagaaggtgagtttatactaccttttgatgctgatgacaagatgagcgaaacctttgtgtctgatgcagtacatgtgatattatctgacatgaaaataaaagcagtatgtcctcgtgctgaatatttcggtgaccgtaaaggtgaatggaaattacctcctttttcgcgtaagttgctggcacggaagaatatgattcctatttgtgctttgtatcggaaatcagattgggaacgggtgggcggttatgatgagcatattgttgcaagagaagattgggccttttggattgctatgttaaaagatggcggaaaggttgtaaccttgcctcgagtgtcggtattttatcgggtgcgaacaggttctaaacgtgtgtccgatcgcagtttaaagaaaaatttaattgacgctttaaatgcacgtcatccggagttctttgaacgtgagctgggagggccacttcactattgccgttcgtggtctgtactgctgaaccgtatctatcgtttgtttcatccccgaaaaatatatgtagcatccgatttttgtacattaaccgattatgtaaaagcgctacctgctttgtttaaatatgactatggtactgtaatttataaaggacgaaacgtactgcgtgaaatggactggcacggtacgaaagttgtcgtaaaatcattccgtgttcccaatctgatcaaccgtattgcatacggtgtattccgttcgtcaaaagcacaacgttcgtttgaatacgccgaaatgcttcgtcgggaaggaatcggaagtcctgctcccgtagcctattataccgaacgcaacggtctgctttttacccacagctattatgcctgtctgaagtcggaatgtccgtactcgtacgtaaacttgatgcgaggcgatttccccggtcaggaagaaattttgcgagccattgcccgcacaacagcagcactccacgaaaaaggctatttgcataaagactattcacgcgggaatatcctgttccgtcgcactgacaaaggtgtagaggtagaaataatagacttgaaccgtatccgtttccgcacggttgatatggaagaaggttgccgcaactttgaacgccttccgggaacaccggaaatgtttgccattcttgccgatgaatatgccaaggcaagaggtttcgatgccaacgaatgtttgaaactaattttgaagtataacaacgcccacatatgagactaataaaaatgacaggtggcttaggcaaccagatgtttatatacgccttctatctgaaaatgaagaaactttttcctcatacaaagatagatttatcggatatgatgcactaccatgtacatcacggatacgaaatgaaccgggtatttgctttacctcatacagagttctgtataaatcgtacacttaagaaacttatggaattcttattgtgtaaggttgtttatgagaggaaacagaaaaacggctccatggaagcttttgagaaaaaatatgcttggccgttgatctatttcaaaggattttatcagtcggagcgtttctttgctgacattgaagatgatgttagaaagactttctgttttaatatggaattgataaatagccggagtcgtgaaatgatgaaaataatagatgccgatgagcatgctgtatcaatacacattcgtcgcggtgattatttacttccaaaattctgggccaatgctggatgtgtctgtcagttgccctattataaaaatgctataaccgaattgaaaaaacatgagtcgactccttctttttatgttttttctgatgatatagaatgggtgaagcagaatttatctttacctaatgctcattacatagattggaatcaaggaaatgacagttggcaggatatgatgctgatgagtcattgtcgaaaccatattatctgtaatagtactttcagttggtggggagcatggttgaatccgagaaagaataaaactgttattgtcccttctcgttggtttatgaaagaagaaactccttatatttatccagtaagttggataaaagtacctataaactaaactgccatgagtatcattttttcgttaataaagaaagtaacctatgctttgtgcgaaagtttgttttgctggggtcggtcttctaaccctattctttatatgacactgctggtgaagaacgaggaagaattgctggaacaaaatctgatatttcataaacagatgggggtagatggatttattgtaactgataataattcaaccgatcgtactcctgacattcttcgtaaatataaagaattgggatggataaaagaaattattcaggagccggcgaccgactatcgccagaaaaaatgggtggatcgtatggtttggtgtgctaaaacagtttttcatgccgactgggttatcaatgccgatgccgacgagttttggtatgctccttcgggtaatttgaaaagtggactgaaacatgtttctgataatgtgataaagtgtgccatacggaatatgtatcctgaggaaggtaagtcgtttcgtgaatggaaatatgttgtagaccctgtaacaaatacggataagtatgatctttccccttattcactttttggcagacagatacccaaggtaatgcatcgtacccggggatacattcagatttcgatgggaaaccataaagtggccatgttccccaagcgttctggcaagagtgatattcgtatttatcattacaatatccgaggtcgccagcagtttttggagaaaatgataaatggtggaaaacagttggaacagaatcccagcaagcatggcgggcgtcactggcgttatttctatggcttgtataaagaaggaaaattgaacgaggaatacgaccgtgtgataggaagccgggttttcgaccgtttgcaggcagacggatatatacatgaagaccatacaatggctgattttttcaagaaccagaataaatagaagaaaaagatgaagcatgcatacctgataatagctcataatgagccaaatattctaaaaacattattacttatgcttgacgatgagcgtaatgatgtctatttgcatgtagatgcccgtgccgttgaattattcaatcaattcaaagattttcagttgaagaaaggaaagttgataatcttgaaaaatcgtatagcggtacattggggtgacctttctcaggttgaagtagaatatcggttgtttgaaactgcgttgaacaatggaccgtatgcctattatcatttattgtcgggagttgatttaccaatcaagacgcaagattatatccatgagtttttccaaaaacatgcaggcaaagaatttatcggattctggaacgaaccaagccatcgtaaagatgtataccgtaaagtttatcgatattatttatttacccaatattttaaagaaggttcttcttttgtacatggtataacggcttttacccgtaatttttttttgggcattcaaaagctgactaaatttaaacggaaacacgattgggataatttttacaaaggttttacctgggttagtatcactaatgatttttgtcattatctggttgataaaaaaacggatatcatgaaaacattcagatatacactatgtccggatgaaatcttcattcagactttgatctggaattctccttttcgggcgaatatttatgatttttcggatgcttcgaaaggtagtatgagagctattgactggcgacgcggaagtccttatgtttggagattggaagatgttgatgagttgaagaattccccttacttgtttgcccgcaaattctcttctaagtatcctgatattatagagcgtttgtttactgtttattccactcttgaacagcatgtatgatgaaagttctatatgtcgttatttttatttatgtatttttgctgttgaaacgtagatttttgtgtttatgaatgaaaaagctccattggttagtgttgttgttcccaattataattacgcacgttatttggatgcgcgcttgtcgtcaatcttgaatcagacttttcaggattttgaactgatacttctggatgatgcttctacggacaacagtttagaggtacttgacagatataaggacgatcctcatgtttctcactttgtcgtcaatgaacaaaacacaggaagtcccttcaagcaatggatgaaaggtattttattggcaaaaggtgaatgggtatggatagccgaagccgatgatttatgtgaacctacgtttttggaaacttgtgtaaaagaggtgcagaaataccctaatgtatctgtttgcatgacggcttttcgatatatagatgaaaaaggtaatatattgccacaagaagccaattattgggggaagaagaaaccggctgtatctgcctgcagattttcgggaagagcttatgcagagcataacatgtattggaattgttgcgttgctaatgccagtggggtgttgtttcgccgttcttatgctactaatttatccgattcttcctttttaaacatgagatacagtggtgactggtgtttctggttccagatgctgttgcagggagatatggtcgaggtttacgaatacttgaataagttccgtcagcataccgcaaaagtcagtgtagaaggtgtcaagtctggaaatcgtattaaagaagatatcgatgtactttctttgatggagaggactttccctgagataaaaaagtataagcgcaggttagcccatggtatgatatgccgtaaaataaaaaagctgaacgatgcaaagaaaagagttgagcttagtgagtatttgagtgagcgtttgggaggaaaagcctccgatttgagacttttccatctgaataattatttaagattcatttgtccgtggctgattacgatcaagcgtgacagactcaaagtattatgattaatagtaagttaagatagaattttgctatattttaaagcttttttccggtctttttcctctgttaatacctttggaatagcgtggaaatgtctatttaatttgtagtataaatagtcttttataaaggacgaatggaagtattttttatagtcttttatgatagactctctaatttctttattttttatatgcttaattattctagcgtctcttccatgtttttgcatccgtttaaagtgattaatagtcggaattttcttttctatatatattccaattttgaatgattcaataaaattctgaccattgtattttcctttggctgtttgcgactgatgctgtctgaaataattcaaagtttggtaaatctgtataacttttccttgcatagccatttcaaaccaaaacaaccagtccccacaatagcggaaatctgtccactttttattgtgaatgttaagtgcatactcttttttgaataatactccactggcattaggaatatcatttttccaatatagaatatattcggcaaattttttaccatcaaaacaaatggctcctgctttgttttcgtttttttcccattgatatactttccctttcatgatattgtcttcagtatcaatatatacgctacctgtgttacaaatagtaacattgctttccatatttatatagtgcatacatatctctaaaaacgtaggctcacataaatcgtcggcttcggctatccatacccattcaccttttgctaataaaatacctttcatccattgcttgaagggacttcctgtgttttgttcatttatgacaaattgggaaatatggggattatctttatatttttctaaaacttttacactatcatcggtagatgcatcatccaataaaattatttcataatcggtgtaggtttgttttaatatggattcaatacgtttatctaaaaaatgggcgtaattataattgggtactataatactgattttaggggaactactattcattttcttattttctaatttatagcgaaataaaagcaaagataatctatttttaagttaaatgaaaaatattgagtttactgcatggctcttgtgaaatatatacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgatatataaagactgatatttaattttatgggaaaaattatatcggttattttaccttgttttaactacttatgaactttcctatttattgttgtaaatgatggctcttttgtttatacaggtatggtttattttcagaagacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgagaagaagaacgtatattaaattgatttgaagaaaatatacgtttgtttagcttcaagggatcatccattctttcttctattgagtatgtttatcgtgaaaaatatatttttcagaactaaaataatcattaattttatttatttttacaagcccattttacggatgatatgtatattgattacaagtaatagtgcctttttatggaacttgaaattataagaatagagatctaacttaatagatgaggtgcttttatgttgtagctttattatgttatgatgtaatgtcgggaaacctgaagttatttggaaagtttattaatcaaaatgtattgagatgtagtctttgttataaatacaaatacttcttgtatttatgaaaattcatagttcaattgcattaagctgcctttagttgttctttatgaacactataatgggggaataaaatttttaattactatttatggaagaaatgatatctataatattaccttgttataatcaggggatatatttaggagaagcattagaatcaattattaaacagacttacagaaattgggaggcgatcattgtaaatgatggctcttctgattgtacggaagaggtagctttagaatatgtagcaaaagatagtcgtattcattattttgcccaagagaataaaggagtatcagctgcacgtaatttaggaattgaaaaggctttaggaaaatttgttttgcctttggatccagatgatatgatagcacccacttttatagaaaaatgcatgagaatgtttaaagaacataatgattgtattctggcttatacgaaaacatccttttgtggtgttaggaatgggtattggaacttacctgtatacgatgattataaaaaactccttctcagaaattgcattgtatgtacatctgtgtttaagcgtgaagattgtttaagagttggagggtatgacgaaaatatgcatattggattggaagattgggaattttatattcgattactacaaacagacaagaaggtgtatcaagtacctgaatcattatttatatatagaataaaagaggagtcaaggagtactcaatgccaaaaagaagagaactggactaaagttctgatatatatatataagaaacacattgatacttatatccattattatggttctcctttagaaattttggataaaatgtactattataaaggaaaatatgagaaatattataatacatggtatcgtagattttggcataaaataaggcctagaagtaaaagaagaagatagaaaactgtagtagcttttcaattaattattgctttccgataaaggtgtatattcttcatatgtaactcataaaatgaatcattagtgtccaataaaaatggactagttaaaaaattaatcaaatagtccttcaaaaaggggataatcgagttctttgacatcgttgaaatcagtcttatcgaacagttcacgcaagttagttttgtccgttagagagatgcttagaatctgcaaaacttcataagttgagcgcttcaattgcatatcgtgttggacaatagccactagacagtaagtgatgattgctacactgatttgaatgcggacagcattttccgttgtgccccagaatctttttattttaaggtgctgcttgagccatttgaagaatagctcgaccaaccatcttttcttgtagagattagcaacgtccaatgcagaaatatgtgttgcgtttgtcaggaaagtgaactcacggtcaccctcttcatcatagtaacgaatgagtcggaatgactcgggatatttcttctctgagaggtatccggtcagtttcacttcagcatctgtaagtacatacttaggcatcctacgcttccatttaaccattgtgtatttcaagttcgtcttagctctgacaacgaaaaaggaacctgtcaggtgtatcctatatagttccttaaaagagtcataagccctgtcgaatatataataagcatttggttcataatggattgaacacatcgctgtagagtcgtgcttcgatgctgtggttacagtatagaaggcaggaacttgtgcttcaatgtcatataagacatgagctttgacacctcctttctttcttcggaacttcgcccatggaaatgtggctagacataacggaatagttgttgaatcaaaagcatacttattccctggaatatccaagatgttggtcgctcgcttttcacaagcttccttcattatatagaatgcgaagtcttcaaagattctgtagtcacgattctgattagcataagcgagggtggctttggctattggattgcgtcccagaccaagatgatattgcttggcttgatgcgcttcaaaagctacaattaagtcgcgaagactctcacgattgctcagttgtccgaacatcatagcaagtaactgattccagcaggtgaattgtttcacgtagcgattaccattatacttgcgaacaaagttattgaattgtgttctgttcataaaagcggtaagttgagcgaatacgtatttatcttggttcataagcggcattcaatttgaccgctaagctacgaattcaaatccgtttcattctaaaatactgcttaaaagactgtatttcaacaatttcaaaggcccattaaccaacttttattggacagtagtgaaaatgaatgtttaggaaagtgagaaattatatttgttaatctgtattctgatagaaaatcaaaatgtaactatttgatagtaagtaatgtcatctttcagctcccataataatcttttcttggtcagtacgattttatcgaaaggcaatatggttaaaagagttgcaggtactaattgaagaaaaattgaaaattataagaaacctgcaacaactttttagtattatatatagattatttattctgaaaaaaacaatgaaaatgtttattgagaaatttacctactttatctacatcgttggatggggcattgctggttggtattctccagtttttaccataccaaaattctagtaattgtagtgtatgattaggtatagtaaatgtttcccctaaaaactccatcgtttttaggttcttgaaaaattttctaggtatcaccttgtataagtagcgtacataaaaagggttcattatcccctttaattcattaacaatgtacacatctatgtagactccatctctaatgaaggaataaatacctgttggctcatagcgacataattttaagccctcacgatctaacataggtatcgcttctatgagcttttgctcatccaatacacacgtgtcaatatctatgtcatgtccgataaaacctttttcacgaattgctcctaacaaggtgccatgcatgatgcagaatacaatgttctcattatccattattctcttgaaatctaatagatttttttttgcaactgttgcatcaattacatgagaattttcataagttaattcgatatcttggaagtggaaaggttttcctttaatgtttattattcccatcgtttatggtattaattggttaaattctataaattgatttagaatcttttatgaatagttcctgtactcttatgatgcttaaaacctcttcctttgtcaatttgaaagaagttttattatgattcatgatacaagaaacaaattctttaatctcatatctaagtccttctccctcataaggataaaaatactttctatttttgtttaaatcttcataccgtgcttcaaaaaattctgttttccaccaaggcgctggtatgtaaatatatcctttggtaccagcaataaccatgctcccttctgatttaactcctaatccaacttgaaatgaagcaatactttggggatagcgtatgatgcatttagtatagatatctacattatttttgaaacgagaataaaaattaatgtcaacataattcacccctaacaatttaaaaataggcaataatgggaaacatgcattttcgttcatgctgccgcctgcttgctcaaaatctaatttaggtgatttttcatctgtaagagtcgtgatggaagcatctacggaaacaatgtccccaattatgtctgactttaaaagagagattaagtggttaaaggctgggtaaaaagccgtttttagtgccatcattaatcgtaaattcttgttattcgctaaatcatatagctctatagcttccttttcagacaaaacaaaaggagtttcacatagcacatgcttccctgattctatagcatattttgtataaaaataatgtgttaaaggtggagatgctatatatatggcatcaacttttgatactaattcgcttaaggaggatgaagcctctgttatttttaattcattacaaaatgatttgcaatcttctaaattgggattatatgctgtatgaatacggacattcgtgataaattttgcttcgttaacgaaacgctttgcaatattacctgtgcctattatacctattcggataatatccctctgtttttcacgtaacgttgtactggatattccttcagttctaggtaaataaacaacttcacaatattcttttaaataatcaaattttccttcccagtcggaacctatggcaaaaatatctacgttatattttaatatatcatctattttttgcccaatgtattcttcaataattatttggtcggccaaccccgtttgttttatggcttctatgcgctctatgacattgttacaaacatttaatttgcctcttcctaagtcaaagttgtcggtcgtgactccaacaataagataatctcctaattctttagcacgtttgagcaaattcaaatgcccttgatgaaataaatcgtatgttccgtatgtgattacttttttcatttgctatgctcaatctgatggatatataaagctaattcatctaaatcataaaatgattgtattcccatatgagaaactctaaagaagttttcttctccacttggcataataaaaatattatatttctcaattaagtcacgaatgattttagttccattatgagaaacataaaaacctgttatggctgaggatggtacttctgctagaattttccaatcatattttttacaaagttttctaaagtatgaagctcgactttgtacatcggaaatcacattctcgagtccataatctaaaatttgatgaatacgtttattcagctgaagatagatggtggtagctggactaaaaggggtctgacctctttccatgttttttaaattgttttcgaattcaaaataatacccttttttagcaaatggatattcttttaaagaagaagacaagaatatgatagatagtccgggaggtatattcagccctttttgagaactggtcaagcagatgtcaattttcaatttatccatattcagtggttctgctaaaaaagagctaatagcgtcgacaactaatgaaatattgtatttctgacagattcttgatatcttttctatatcgaaaagtgctccgcttgaggtttcatgatgctgacataaaaaaacatctggtctttctttacagatttgctcttctaaattcgtataattaatatctttcccgaaaggaactttgtaaagagtataattacaattataataagcacatagttctgcccagcggtatccaaaagtgcctcctgcaacgacaaatgctttttgctttgttgttacatagttttcaacaacagctgccattgctccagttccagacgctgtataaataatggttttaccttctttacagccgattagttccagtaaaattttctcggaatctttgttaattgctgaaaattcggcagttctcatgtaagggatttgaagagaacctaattgtaaaatttcttgatttatattgccggggaaagcatatgatttcatagggcttagcttttatttgtaagcaaaggtattaaataatctcgaatggacaattattttattctgcatcaggtaattttatttgttttatttgttatattagaactctttttatttgtactaagttaaaagcataaatttatggtaccagtattatccatcattactattaattataacaatcggttagggcttttgaaaacaatgcaaagtgttgtagaacaaagttttcaagactttgaatatttaataattgatggaggaagcaatgacggtagtctagaagagattcttaactatgagcagtatttgagcttttggtgctcagagaaagataaaggagtatataatgctatgaataaaggaatagcaaaagctacaggagagtatttattattccttaattcaggagattctctattggataatcagatattatccaagattgttccgctattgaaggattatggtattatttatggtgatctcatttttaagtatggtactaaggatattttgcagacatatcctgatcgtttagatattggttatttgttttattattcattaggacaccctgcttctttcattcggagagatttattacagaagagaccatactcggaggattttaagattgtttccgactgggaattctttttttatgaaataatattagacaatatcccttatatgcatataaatcaggctattagcatctttgatactaatggtattagttctaatctggaaaaatgtaaacaagaacagatagaggcacttaaacgtatatttcctggaggactgtatgatatgattgaagaatatgcagcaatgaaaagaagtcctcttttccctcttttttatgaattacaaaaaacaagaaagtttcagcttaggattaagccattgttaagcttcttgattaaattgaataatttcattgggagaaaaaggtagatcgggagatgtttgtagaaggagttaaaataataaatacgcaatatagagtatttatttcagatgatctaatactgaaaacgccttcatctttttttattttttgtacaaattccaaaaacttttgtacaaaaaataattgagaaagcggctgaagagaaaataaaagatcttgtgctaaagaaaaatagtacaagatctttttgtaatattatgcgtttggtatggtaagaatttacagagcctgcatgtcgttcaagcgtttgtaatagccgtttttctgaagcagttcttcgtgtttaccgctttctactatacgaccttcatagagtacatagatgcaatcggcatttttgatagtcgacaggcgatgtgcgatagcaatagtagtacgggtcttcatcaggcgttccagtgcttcctgtaccagacgttcgctttccgtatcgagagcagaagtcgcttcgtccagaattaagatggctggattcttcagaatagcacgggctatcgagatacgctggcgctgtcctcctgacaagcggcagccacggtcaccaatgttggtatcgtaacctttttctgtttccataatgaaatcgtgtgcattggctatcttggcagcggcaacgacttgttccatggtagcattgtctacgccaaaggcaatattgttgaagaagctgtcgttgaacaagatggcttcctggtttacattaccaatcagtccgcggagatcttttactaccagatctttaatgttctttccgtcaatcaaaatttcaccttcttgtacatcatggaagcgaggaaccagatcgaccagtgtcgattttcctgaaccgctctgtcctaccaaggcgatagtttgacctttgcgtactttcaggctgacgttatgaagcacttcatgggtaccgtagctgaacgagatgttgcggaactccagtccttctttcatttcggtgatgtgttcggcatcaggacgttctgcgatgttgttgggagccttcagaatcttgtccacacgttccattgaggcaagccctttcgggatgttgtaacttgccttggagaaatctttcagcgggttgatgatgctgtaaagtatcaccatatagaaaatgaaggtggaagcgttgatggtagagttagcacttagaatcagtgagccaccgaaccaaagtacaagtacgatgagtacggttcctaagaactcactcatagggtgggcgaggctctggcgcatggctactcggttggtcgcattacggaattcgttgctgcattttacaaagcggtttatcattttatcttcagcgataaatgccttgataatacgcataccacccagtgtttcttccagctgtgacatggtttcactccatttgttctgagcatcgagtgactgacgtttcagttgtcgtcctacgcgtcccatgatccatcccattcctggcagtacaatgatggtaaacagggtgagttgccagctggttacgatcagagttgcaaaataggaaatgataagaatcgggtttttcagcaacatatcgagtgaactggtgatggagttctctatttcacctacgtcgccactcatgcgggcaatgatgtcaccttttcgttcgtccgacaagaaactgagcggcaggtacattacctttgagtaaaccatgatacggatatcacgcactacaccggtacgaagcggaatcatgatggctgtagaaccgaaatagcatgcggttttcagcaatgtcattcctgcaaggaagagtcccagccacagcaatgtagtagaagggccgaacttgtctatcagttgggatacgtaatagtagaaattgtttacggcaacatctttcagttcgccgcttccccattccatgaaatgatatactttttctgaatcgccggtcttgaacaggatattcagtatcgggatgagaagtgaaaaagagaagacattgaataccgcggacaacaggtttagacctactgcgccgataacatatttcttgtagggcgagataaaccgccgcatcatttggaaaaattctttcatgcaggaaatacttctgttataatatagtgcacaaagatagtgtaatttattgttttctttgatacaaagagggggcttttgcatattattttataaatttgcaatttaactgaaacatggcaattcaatgaaattcatatattatctggtttttttcttctggtatctgctctctttgttaccattgagggtactttattttatttccgatatgctgtttgtcccgttattctatggtttgaaataccgtcgggatatcgtgcatcgtaacattgccggttcatttcctgaaaaaagtgaaaaagagattctgaagatagagaaggagttctatcattttttctgcgactatgtggtagaaactatcaagttgttttccatgtcgaaaaagcagatgatgaagcgtatgacttttagcggactggatgaggtgcgggaaacattgggaagggaaaataaaaaatgctgctttctttatttgggacattactgtaactgggagtatgtagcttccttgcaatactggttcccagagatacattgcggacagatttatcatcctctgtataataaagctttcgataagttgtttctccgacttcgcggacagtttggtggtgagtctattccgatgaaggaaacgttgcgccggctggtgacgctcagtcggggagagaagaaggtgatgataggctttatttctgatcaggctccgggatgggaggggatggatcactggacatcattcctgcatcgggatacagctttctttcagggtacggaacgtatcggtcggcggctggatgctgcggtctattatgtaaagattaccagagtaaaacgtgggtattatcatggtacgttcgaactattgaccttgcatcctgccgaattgcctgagtatcggctgacggatatgtactcggagcatctggagcaacagataaaggaagctccggcttattggttatggagtcataaccggtggaagcggacgaaagaagaatggttgaaaatgtcgtggaacactaaaaaatcgtaatatcatgcccccgaaaattattcatttgtgctggttcagcaaggatccttatccattggaaattaagatttgtcttgcaagctggaagcgtgtgcttcccgattatacagtgcgtgtctggacgtacgaggatgcaaaagctatcggttgtaagtatatagaccaggcgttgtcggtcagaaaatgggcgtttgcagcagatgttgtccgtttttatgccgtatataaagagggcggtgtgtatatggacagtgatatttatctgcgtaagcgtttcgatcggtttattcctgaaaccggatgtgctacattcaatgaacggtgggaggaaggagaaaccgattatggcattcaggctgccttttttatcggttcaaagggaaatgatttctgtaaggaggtctttgaatattatcagacgcgtgattttattcgtcccgacggttcgctggatcagacggtttcgccgtatatcatgcggagtattgcggagcgcaggggatatgtctgcaaggaagaagaacagcatctgaagggtattgatatttatcctacgcattggctgtcacccagaagccgtttcaagcatagtccggatgcgtttggggagcatcgggtgtatggaagctggcgcgaccataagttcggcagaaagttggaacgttcgttcaagcatttctgcaatgccgtgaagttttatttgttgggcagataagaggactttcctccactattgagatacaaaaaagtcgcatcattactctctatatgagttttgatgcgacttttcttagttatcggattcctttccgctgtttatattcatcgattcgtttctgaaaagcttcttctttcttgctgccgttggaatggaatatcagagcttcggggatttcttttccacggtcttccagtcggacttttccgtctttatcttttattaaatcgacagcatcgtataaatcgttggtggtggcatcgtaggcgttcatggtaagggtatcgccatgcacacggatttgctggtaataacggctgcccgtaccgaacttgtcgaatcgtttatcgaactcgatgagatagttcttgggtgagcagtggctgacggtataaacagggggctggggctctccgttttctccgtggccagtcatacgggcataagcgtgttcatgtccttgcagtacgaggtcgacaccatatttctctaccagcgggttgaacatggtgcgctggaacaggttgttcatgcttcctttgatggagtacagcggatgatggagcacgacgattttccatcgtgcatcgcttttcttgagctgttcttccaaccattttttctgagtccatagatagaagaactcacggttgctgtcgaggcagaagatttgcatgtcgttgtatttcagggtatatacctgattttctcctaccattgagtcgaggtagtaagagaataccagtgagaagcggcgttccagcttgcgaatgatgtatttcaggtattcatgatttccggtaaccgtaatgacgggatagcgttgtccgatggaatccagcccgcgatatgtttcttcccagcgttgttcagtcggacgctcggtcaggtcgcctccgaaaacgaaaaattcagtatcgggatggcggcgcagagctttgcggaagaagtcgttggcttttccatggatactgtcttgtacatcacctacatacataaatgaatagtcttttcgggtggactgattgtatgtgcggaaactataccaggatgaggccttgtcttcattgcatactcgataggtataataacggtcgggttgcagagaacgtagcttggcaacatagtatgctgctattccgctgcgcgaacggaaggtttctccttgtgcttcaatctgtatggtatctttggaaagagtgtctaccaggtcgacgtgtgacggtacgactatggagtcgtattgccagctgatgttgcgtgacagttcgtttttgtcgccgaaggtcagcagtaccctcccgggctctgacagtggtgcgtaaggaagttcttcttcgttgtggaaccatgcgctccagcgtgaattaatccacaatccgagtgccacgatgacaatcagtgtgatgctaagtcggatgatagttttctttttcatgttgtgatagattggttttcagttgcaaatataaggaaaggtgtttgaagtttcttattttgtgttctgttttgccgaaaagttattttaaaataaggtcttaggcaggtttagaaaataatcgttaactttgccgttcttaacttccaaaaacattggcaatgaaaaaagaattgttttcgaatgtgctttccctgatatggaatttgctcattatctatgtgtgttattcgctttgtcgtctaacctttttgctcgagaacttccgtctgttcagtgagaatctgacgtggaaatatgcgctgaatatgttcggggcgggtattatcttcgatacgacggctattctgtatagtaatgccttgtttatattgttgtttctgttgccgttccattggaaagaaaatgctaccttctataaggttgtccgctggatttttacggtggttaacggtcttttcctgatatcgaatctagtggattgtgtgtatttccgtttttccggacgacgtactacgatgagtgtttttcaggagtttggacatgaaggcggaggtaacttggcttctatttttatggatgagtttatttcgcactggtatctagtgattttggctgtcgttttctgttatggtatctataagctgtatcgggcaccgcggaatattccagtatatagcaaatggcagtattatgtgttgcagacggttaccttactgattgccataccgtttacggtatttggtatgcgtggaggtatgacaactgctacgcgtccgattacaatcagtaatgctaatcagtacgtagaccgtccgctggatgcaggagtagtcttgaacacaccgttttctattttccgtacattagacaaaaaaacgtttcttgtacccaattacatgccggacagtgaagcggttgccgtatattctccggtgcatgttcctgccgattcggtacagttcaagccgatgaatgtggttgtaatcatctgggagagctttactaaggaatttgtgggcagtctgaaccgtgatctggataatggaaagtacaaagggtatacgccgtttatcgattcgctgttgacaaagagcttgagttttacatatacatatgctaacgggcgaaagagtattgagggaatgccttcggtcttgtcgtctataccgagttttgttgagccgttcttccttactccggcttctctgaacgatgtgtccagtatagccggtgagctgaccaagaataaaggatattattcggctttctttcatggagccatgaatggttcgatgggcttccaggcgtttgcccgttcagctggttttaccgattatttcggacgtacggagtacaatgaagatccgcgttatcacggggatgaggatttcgatggtacatgggctatctgggacgaagagttcttgcaatactattgtgacaagatgacggaattcaaacagccgtttgttacttccgtgtttacggcaagttcccatcatccgtttgcaataccggcacgttatgaaggtaagttccccgacggaccgactccgcttcagcgttgtatcggttacacggatcatgccttgcagctcttttttgagaaggcttcgcatcagccgtggttcaagaatacactgtttgtaattactgccgatcatactagctttggtacatatcctgagtatctgaccgacttgggactgtatagtgtacctattttgttttatgctcccggtatgccggagctccgtggaatggaagataagattgtagaacagattgatattatgcctactgtattgggactgttgggttacgaccgtccgtatgtaggtttcgggcaggatgctcttcatactccggcagctgataagttctcggtaaataatgtgatgggtacgaatgtttatcagtttgtgaaaggaaattacatgattcagtttgatggtgagaaagtattgaaggcttaccgttaccgtaccgaccgcctgctgaaagatgatgtgaaggatactatgcctcaggatacacttcgggcaatggaaacgcaattgaaatcgtttatccagcagtatatgcagcgcatgaatacaaacaatctggtttacaggaaatgattcctgtattccgggtaatgttgcgtccggtatgggcgtgaagagaatatacgaaaacaggaaagggcaagctcagcttgccctttcctgtttttagtctgtatagatgattgttttattggttcttgtttgcacgcttacgttctgtttcgtccagaatgatcttacgcatacgcatgctcttcggagttacttctacatattcgtcttccttgatatattccaaagcttcttccagtgagaagataaccggaggaataatacgagccttatcgtccgatccggaagcacgcatgttagtcagtttcttcgatttggttacattgacaaccaggtcgttttcgtgaacatgttctcccactacctgaccggcatatacttcgtcctgaggatagataaagaacttaccacggtcttgcagtttatcgatggcataagcaaatgctgttccgctttccatggcaatcatagaaccgtttgtacgacgaggaatatcacctttgtatggctggtattctttgaaacggtgagccatgatagcttctccctgtgaagctgtcagtacgttggtacgcagaccgatgataccacgtgaaggcatatcgaattcgatgtttacacggtcgccctgagtttccatagaaaccatttcacccttacggcgggtaaccatatcgatcatcttgctggcaaattcttcgggtacgctgatggtcaactcttcaatcggttcacattttacaccgtctatttccttgaagataacctgaggctgtcctacctgaagttcgtaaccttcacgacgcatggtttcgatcaggacagacaagtgcagcacaccacgtccggaaacgatccatttaccatcttcgttttctgtcttgcgtacacgcaatgccaggttcttgtcgagttctttcatcagacggtcgtgaatgtgacgtgaagtaacatacttaccttctttaccgaagaacggagaatcgttgatcgtgaacaacatactcatggtcggttcgtcgatagcgataggaggcagcggttccggattttcgaaatcgcagatagtatcaccgatttcgaagccttctacacctacaatggcacagatatcgcctgaagatacagactgtactttcttgcgtcccagaccttcgaaggtatgtacttccttgatttttgatttaaccatcgtaccgtcgcgtttagcaagtgtaatgttcatgccttcgctgatggttccgcggtgtacacggcctacggcgatacgacctgtatatgaagaataatcgagtgatgtaatcagcatctgcggagttccttccaattgttggggagccggtatatatttgataatagcgtccagcaacggagtgatggttccggtcggagtcttccagtcttcacccatccagttgttcttggcagaaccgtaaagaaccgggaagtcgagctggtcttcggtagcgttcaagctgaacatcaagtcgaataccatttcgtaaacctcttccggacggcagttaggtttatctaccttattgacaaccacgatcggcttcaaaccgatttgcaaagctttttgcaatacgaaacgtgtctgcggcatcgggccttcgaacgcatcgaccaacaggatacatccgtctgccatgttcaagacacgttctacttctccaccgaagtcggcgtgccccggagtatcgataatattgatttttgtacccttgtaattgatggaaacgttcttcgaaaggatagttatacctctttcacgttccagatcattgttatccagcaccaattcgccattggtttggtcattgcggaataagtgtcccgccagcatcatcttgtccaccaatgtagtttttccgtggtctacgtgggcaataatggcaatgtttctgatatcttgcatactatacctaatagaaatattatttggagtgcaaagttacgatttttctttgatatttgtagtgaaaatcttgattttgggtgaataaagttgccagatcatgatgcagccgggctctactggtcggtgttgaaaacgtgatacttgaaatcttagtcaatgaatttcgtgtgcagatgacatgcgctggaatatatttcggggcgattatcaatattttttcgcttaactcattgttatatggaagattatctttacctttgcaccgcaaaatcaaaatttatatattttaaacagtcaaaattatgtatttagacgcagctaaaaaacaagaaatctttggaaagtacggaaagtctaacactgatactggctcacctgaagcacagattgcattgttttcataccgtatttctcacctgactgagcacatgaagctcaacagaaaagattatagcactgaaagagctctgacaacactggtaggtaagcgtcgttctttgctgacttacctgaagaaccgcgatatcgagagataccgtgctatcgttaaggaactcggtctgcgtaagtaatccgttacttgctgcaacagaaaacaaatcgagccgcctcttgaagaaagggcggctcgatttgtttttataggatttgtatccggtttattccggatactgaagttgtgcttcggtgatgttttccaatacttcgtgcaggtatttggctgcttcccaacgtgccatcggaagattcatcatcaggtagttgccacagtcttttgcgctggctccgggtacatcgccctcaaaatcggctatgaagcggaaagtttcctgcatcagcggaaggatatcttttgattcgagatcaccttttacaaccagataattgccggtaaggcagcccatagggccccagtagatgattttatcggcccataccggatggttgcgcaggaaggtagcagccaggtgctccatggtgtggatagccgaagggctaaggcacggttcccggttcggctctttcatgcggatatcgaaggttgtgacgatttcgtttcctacagtgtctttgcgtgatacataaataccacgtaacagacggatatggtcgacggtaaaacttggtatttttttcataatcctcttgatttaattataatttgtttggcaaagcctttaagaatgtttctgtaacgtggaaggaacggtcggccatttctccccagaaattctggtattgttcgaaatgcttgtctgctcccggtgtatcgctgatgatacggaaactgataaacggaactttatacaagtaacaaacctgagctatggctgccgattccatgtcgacggcaagaccttcggggaagttacccttaatggtatccagttcgctgcggtcggtaatgaacttgtcgccgctgcaaatcagtccgccgtggatcgctgtttccgtatcgagcgacatggcacagttgtaaagcgtttcgtcgccgttgaagaaagtagggagtccctgaatttgtccgtatgcatttccttcgccgcaccatacgtcgtggtacacgatttgtcggcttactaccacatccattactttcaggcaggtatcgatacctccggctactcccgtactgataatgcagtcgggctcaaaattgcggatcagctctactgctccggcagccgcattcaccttgcctataccgcattgcatcagtataatggtattgttcttgatggttccttctatgtagctgaaaggacctttggtacattctgttttttctctcagttggttagccagctgcttctgctctgaagacatggcggttatgattcctattttcatattattttatgattttcgctgacaaagttactatttttcatggactattgtgttatctttgctgtctgaaaacattaattaataaactatttctgtatgaatcaattaaagaaacttctccctgatattgtggcgattgtgctctttgcaataatatcggtcgcttatttctttccggccattacagaaggacgcatcctggcacagcacgatgctgtagcaggtatcggagccggaagagaacatcaggaatattacgaaaagcatggtaaagctacccgatggacaaactcgttgttcagtggaatgccgacttatcagctggctccggggtatgaatcgagccgtacactgagttttgttcaggaaatctaccggctgtttctccctacttatgccggatacatctttatcatgctgctgggcttctacatcttgctgcgcgcattcgattttaaagtctggttgtctgccttgggagcaattatctgggctttttcttcctacttctttatcatcattgctgccggtcatatctggaagtttgtgacacttgcttacataccgcctaccatagcaggtatggtcttgatataccgaggtaagtatttgtggggtggtttggtgactgctttgttcgtggcactgcaaattgtgtcgaaccacatgcagatgacgtattatttcctctttgtcatgttgtttatcgccatagcttatggagtttctgcatggaaggaaaagcgtttcccgcagttcctgaaatcgaccggagtacttgtggttgcaggtatcttgggtatatgtattaacttgtcgaatatctaccatacgtatcagtatagtaaagagagtatgcgtggaaagagtgaactggtgaaagaacactcggctaatcagacgggaagcggactggaacgtgactatattactcagtggagttacggcatcggggaaacattttcgttgcttgtgcctaacgtaaagggtggggcttctgttcctctttcacagaacgaaacggcaatgaagaaagccgacccgacttatatgggactgtacagccagattggtcagtactggggcgaacagccgggtacatcgggaccggtatatgtgggagctttcgtgatgttcttgtttattttaggctgctttatcgtaaaaggtccgatgaaatgggctttgctgggcggcacgctgttttctattttactgtcgtggggaaagaacttcatgggactgaccgatttctttatcgattatattccgatgtacaataagttccgcgcggtatcgtctattcttgtcattgccgaatttacgattccattgctggctatcatggcattgaaggaagtgattgaccgtccttcgctgttaaaggaaaaggcaaaagctttctatatcagtctgggactgacaggcggactgtcgttgttgtttgccattgctccgcgggtgttcttcccgacctatgtttcgagcatggaaatgagtgctttgcaaaacgctatcccggccgagcagcttgctcctatactgatgaatctggaggagatgcgcgtagcgatctttacatctgatgcctggagaagcttctttatcatcatcattggtgtagccttgctgtgggcatattgcgccggaaagctgaaagcaggttttctggtagcggctttggctgtattgtgtctggtagatatgtggagcgtgaacaagcgttatctgtacgacgggcagttcgtggcaaaaggtaccgagatgcagcctttcctgaagccttcggaaacggataagaagattctggaagataagacactcgactatcgtgtactgaatctggcaagcaatactttcaatgaaaacgagacttcgtactggcacaagagcatcggaggttatcacgctgccaaattgcgccgttatcaggaaatgatagaagaacatatacaaggtgaaatgggtaatctgtttaaggagcttcctgctgtaggtggcgatatgacacaggtcgatccttctcatttctctgtattgaatatgctgaatactcgttacttcatcttccctcttcaaggaggttctaccgttcctatttacaatccgtatgcgttgggcaatgcctggtttgtagataaggtacagtatgtgaacaatgcgaatgaggagatagaggctatccatcatatcgatccggcaaaggtagctgtcgtggacaagcgctttgctgacgaagtgaaagattcgggtgctggaaaagatagtctgagtaccgtcgtgctgaagagttacgagcctaatgaactgatttatgaggttaactcacagaagggtggagtggtcgtattctctgaaatctattatccgggatgggagtcatacgttgacggaaaagaaactgttcacggacgtgccgactacattctccgtgcgatgaatgttccggcaggaaagcatacgatacgttttgtcttcgatccgagatcgctgcatgtaaccgaagccattgcttttgccgcattgggtatactggcagtggtagctatcgtggccatcgtattgcaactgcgtaagcgcaaagaagcataaggaagattcggaaaaatccgttgcaatctttcgaaagaatttgtacaaaagaaaaaaacttttgtacaaaaaataagaaaacgtcaggacatctcattcaaaatgtcctgacgttttcttattatataacgaatttctgtttcctctctgaaggtttcttttagggatcggctataggatatacaactgtttcagcagggtatttgcccaatgatattctttggtaagccattgttcgtcgtcctcgctgtgaggagcttgatggatatcgttcaataacttaatgtactggttgacttcggttacggcatccttctgcttgttgtcgcggagcagtaaaagaattttctgtttcgagatattcacatcgggaaattcactcatagattctgctttttccagcagttccttgctttcccgattgctttctgcggtattgctctgcttcatgatacattttgccataaccacataatcgtcggcacaagccattttgttatcgatgttcttttgagccagcttcatggcctgcatgtaatctctgttgaactccatcatggatgcagaaaagcttaccaggccgctggtacgtttcagatagataggatctttgggtgtttccttcagcggatagtctttctgcaacttctccaatctctcttccagactgctgtatataccgtatttttccagtacgcttttatcttttatctcgtcgtaatactggagaattttgttctgagctgagaccagtgcagtcggatcttttttcatgaactgcatgaactggatagcggtattgtccgcctctttttcctgttgcttggagtaattcagtcccatccggttgtaaatatcatagtttaccagtacctgaacaatgtcgttggttgtaaaggcagcccccggaatgtaattttcgaatctattgtaaagtgcagcttctatggctgtggtagcaacatcggctacggcaccccagaatgctgctcggttggcacgacttatgtttttattgacagttatcacggcgtggtcgagtacatagtgtgccatttctctggcaagcatgctgaataactcatcttccgtatcgagcagcgtaagcagtccgcttgaaaccagcatacagttgttgctcaacatcacaatgtctggattcggagatttcaggatacgtacataaggcattccatatcggtcggcgatgaattctttgggaatcatgctcagcataaggcagtgtacatagtcttccatggcagcatcctcgtaaatcatattagctctttccagctcgtcgaggtacgtattggcttcattctccatttcttttctcatggtttcctgaagtcctttactttcgtaatatgttaccaatccggaattgatttgttccgacagccagaaagttgtcggattagtaggagtaaactccagtctgtccatgttattcagtgcgacaccttgttggcgcccgttgataatcagaactgcttgccggtagttaggatccgttggctgatattgggtcagctttacgaagcgctggagtgtgaacggagtgcctgccttgatgcttccaatatcatcttttacaatgccttttatataaattgacggactgaggctcgtaatatgtttctgggcgatcattcctgtgcatgctgtacacaagaagaacaaggttaaagcgaattttttcattgtcctgttcgtttatggtttctgctgcgcaatgtaccatcttttatcaggccatccaataaaatagcgttattatttgtgaagcagcaggcgtaatgcaaaccataagtgtcgcaggatggttgaaaaatatccgtaatgcttgcacatgatgcggaagcgttctttcagcgaagccttgtggttacgggttgtcattccttcgttcaggtaatcgatcagggtgaggtgggtattatgaagtgtcttgctctgcttcatgatacggatacaccagtcgaaatcggcagaaaagcggtaatgcaggtcgtagtttaccagtctgtcacggcgggcaaaaaaggcctgatgacaaaccagcatcccttcgcggaaacttttccatgttagttgttcgggagctgaaaggcggcgcatccgcaggaaatgtccttcttcatcaacgatggcagtttctccgtacatcacatccggcaattcgttgacgccagccagcgaatgtaccatcagttgcagggtatcatcctcatgaagttcgtcgccggcattcaagaaacagacataatctcccgttgccagtgccatccccttgttcatggcatcgtacaagcccttatcaggctcactcacgatggtgtggatgtgatccttgtaacggttgactatttccatcgtcttgtcggtcgacttaccgtctacgatgatatattctacgtttctgtaagtctgggtaataacactctgaatagtatcttccagaacgttttcggcattatagattacagtaataatagaaaactttggatgcagatgtgtaatgttatgcattttcccctgtgatgtgattataaatctttatatatttcatggcaacattctgttcggaataggtctctaccgcttttcggcgggcttcttcgctgaggctggcgtagtctccttcgttcagcgaccagcatataccgttggcaagatcttccgacgatttgtattgtgctacgtagccgttgtgcagatgatcgatcatttgcggaataccgccgatgttgaagcctacacacggtactccgcatgacatcgcttctacaatggtattcggcagattctcctgcaacgatggagtgacaaacagatcgactgcattataaatgtttaccaattctttttcattgcctacataattcagacagtagatagggaagggaaagaggtcggcatattgctgcgattcttttcctactactacaactgccagtgaactgcaaaaatccggatgctgctgttggatgagtttacatgcttctaccagatagtctatgccctttttcgggtcggttatcttcatggaactgaacagaagcagtttcttgtcggtaggcaggttcaggctgttgcgcacctgtattttgttcagcggatggaacaggttggtgttgatgggattcgggatattggttacggtatgtcccagtgccagcacactgtgcttggccagtccttcgagccatcggctgcatgcaacgaatgtgatgttagccttcttgtatagtttttgttttttcagaaaaacccgatacgacaagtcgtgcttgtagcctttgtacagcaacgggcatgtattacattgcgtctgatacttggtacagtcttgtgcgtgatggcagataccagtaatgggccacatatcgtgcatggtccatacgattggttttcctgaatcgatgattttctgtatgtccttcagggagagcattccttgattgatccagtgcagatgtattacatcggcctgctgaaattccggcagagaggttatgtctgttcccatattggcaatgtcgacggcaaagagattgtgtttcttgaaatggttggctttccagatcactacacgttcccatacgaattgccagatgtgtctccacgacttcttcagcggtactacggtaacctgatcggtttgtttgtcgcgtaccagcatcttggcctttatgccttgtcctttcagcgcttccattaagcggtttgccgctattgccgcccctccgattcgctcggaagtattaatgattaatactctcattgcttcctgaattttgtgcaaaggtaattcattttctttttccttgtctgtgtcaggcgccaaaatctcccttcagggtgcgcttgatgcggcgaatggcttttgcccagaaacaattggtgcggtgatagtatttttcgaagactcttcgtgctgccttgttctcttctatgggagaaataagtttgacgggaagaggttgttgccacagggtagagtcgtacaggccgcctccgccgcagttggttccgcttccatcgaatccagtgttctgaatcagcgattttcccacgttcaacgataagatgtcggcaaggaacaggctggcattccagcggatggcccatgagttgttttgtcctgcaatttgtcggcgtaacatccgggtaaaaggatagttaccgttgaagtcaaaatatcgtgtgagcttgcgcttctccagttgggcaagcagttcttttccatcgggattaaaatatttccatgcacgcttccaggttccccatccccagcttcccgtccatttgatgaggaaggtgtcgggtagtgaggagtccttagtaaagtcgcaggcttggatgtgaccgactcgctgttcatcctgataagtttccaacgcatcgttcatgaacttcagaaaataaggagcaactatcaggtcgtcttccagtacgatgactcttccaaattcgttgacttgcgttgttacgccgtcgatgatgttgcgggcaagtccccagttggactcacgttcgatgatggtaatactcttaaatccgctgatgctgtgtatatagcggcgtacttcctgtacggcggcatcattgtcgggagttttactttgatcggcgtaaataaacagtggactttcggctgcttcctgattacgaagcagtgaagaaacaacctgacgggtatgttccggtcggttgtagacgaataacagaatgggtgcgtatgtcatggcttatagataactggcgtaattttgtttggtttgcttacggacttgtatcaccgccttactttgtgcaagtaaggtggcaactatagagatatatcccttggcatatttgaggttgcctttcgagagagatagaatcagttttttgattcctgccaagataccataggcaaacgcttgggtgaaacgataattgatgttggcatattcggaaagtagatagacacgttctgcccgacaaaacccttcaaaagatactttacggaactcacggtcgtgacagccgtatacggtcggtaaataacctatcttatactggtggaaatgcaggcggttgacgtaatctttatcttctccatagtggtaaaatagaggagaaaatcctcctaccttacgcaatgtactgactggaataaaccagaaagctgcattgataaacggacaaactatcggatcttgtccgtcggatagattcttgatacttgcaaggcgggcataggatgcaaatcccttgtcgagttctttcccgcttccatttaaatgtacgggagaaagaataccgaattctggatggcgcacagcttgagcggcaagtacagccagtgtatcatttcctatccaggcatcctgattcagcagaaagacagcatcatagccttctttcatggcaatctgcattccgatattattggctctgccaaagcccaaatttgcgctgtttgcaatcagtcggacctgaggatattcctttgggataatttctacggtccggtctttcgaacagttgtctatcacgatgatgtccgtgggatgggatgaggctttcagactattcaggcatcggcttatccacttttcgaaattatatgaaacgatgattgtcaagattttcatcataccagttgtttgtcgtgagcaattatttcaatttcatccacaaagtagtgaggcggtctttcactctcttgtgcaggctgatatgaggaatacccgtatatcttccagcctttttccagaaatcggtttcgtcggctatttctcctccattcttttcgatcaacctgtataaataatacaacccgcgcttcttttcatatggtaagtgccataccggatagttttcatctcccggttgcacattgttgaaatgaggagtagtccacatgcgcttcacgtatcggttggctgttgtattgcgtatttgtaaatgttcggcaagcaaacttagtaaatgagcttcctcatttaacttgaatggatgctgctttccatacttcaggttgaaagtccacagctccggaaatgcagtattgattttactgattacatcttttcgtaaggctacaaattcacctccgtagtaagtcatggaaccttttacctcttttccgtaacaggctcggtacacttcttccatttggggaagcgtaattccgttgatggtgtattttctgtcggtaatgaattcataaagagcactaccgtccttgcggacagcctcaaacaaggtctcgagagaggtatggcacagacagtcggcatcgctgatctgtaaggtgtcattttcttgcatacgggtgtccatatactttaagatatcgtacagatagaactgattttgccatgccgggtaccagtctttgggaggcttgcacgtatagggtaacgtaattacctctacgtccagtttacagaacaaccgagtaaggtaatcgggcaaatcttcttttgtcagattcgtaaagaaaataaattttgcttccggattataatacttgaacgttacgaagaaaggcacttgtatttgcatgtaaatggaatgtacaagcgaagagtttcctttctgtcccagctggggatagaaactggcttcctctttcgattctttatagaaccaggttgttatgtaattgacgggtgtctgcatggtcttttcagggtaaatagtgttcaatccatgtgttgatatcgtatcgttgccttatctgttccggaacttcggttacaggactttcaacaaactctttgatgccttcaagggaatcttctccaaaaataaaaatatttttcggattgtagaagtcataccggcgaatatccgtgttattcgttatcagtttcttattataaaataaggcttccaccggacgcctcgtcagtcccacctgattggcttgattgatatctatgacacatcgagacaaggagagttgtcggagatactccggataagaaatgccttccttggcggtattgggtatgataaaattacattttagtcctttattttccagcaattccttcagggtctgtagttcttccattcggttttttgccagtccgcagaagaaacagtcggaggtcacctgctccggtagcttttcagaagggtatctgaaatactggttcgtaaacgttatgtcgtattgttcggcatcttggggatcgaatgtgctgagttcgtatcccaattgccggatggcttttaaatctttcgatggatttttgaatgtcgtatgaatcggattgcaataataaatataacatctcactccggcaggcagtaaagaacggatcgccttcagtacattcacattacatccttcgtatatcaggatggcatctccggctttggcctgaagcattctatccaggtatgtcttttcaaaccaagtatataaaatcgttttgggcagacggatacgtcccacgagtaaggctcgtgtcaattgtttgatacgagtcttgggaaagctcaaaaaatcgggaagatatacgattcgttgttgcttgtcgggggtcagcccgtcgaagatgaatcggggagcacttacaatatacaatttaccgttcatgatactttcttctttagtaagtaattcatacactcatgcataatttcagcattgctcagttgcatgattcccagatagcagatggctgctaccacaatcttaatgataaatgtcagtacgagaggacctcctgtgaaggatgccactattcctccgatgaaacaggctacgagggccggcagcatgaaaggaagcaaatcggacagtagcatgcgaaacttgagaccgatgaaccgatgggcataaatccgccagatgaacagccataggatgttgatacagacataaactatcaccatttgttgtatgctgcctttcatcatgataatactcaagacagttatcagttgcagtaccacttgtgatatgatattccacatgtatatattcgatttcccttggctgatgataaggttggaaaacaatgtgctgatcggaataaaagctcctccaatgcataaaagttgcatcagtgagatgcttccgatccatttttctcctaccgtgatgaggatcagttctcgggtaacggtcgacaagccgaacatggctgggaaggcaatgaatgctgtaaaacgaagaatttttcgaaatacccgcaattcgcgttcccggtcgtcacgtactttgacaaatatgggctgtgcaacactgtttagcataccggtaatgaactgatgacctgttgcattccatttatttgcctgattgtagttacctaccgactgagaactaaaaaacttacctaatatcaccgataagatattattgtttatctggttggctatattggttattaaaattttgctactgaatgagaatagcggtttcaacgggctgaaattaatctgtagagtgggacgccatgaggaaaaataccatgaacaaattgtaaccactatgagataggtgaggctttgggtcgcaatgccccaatatgaaaatccatagaaagccaatgtgactcccagacatccggatataatgtgtgcgaggattcccgatacggcctgttggcgtacttttaggttacggaataaataggctccttgtacggttcctagactggctatcggtatggcaagaaagcaataacgggataatggcaatagttccggctccttgtaaaaatgagctattagcggggcacagaagaataaaatcaggtatgctgctatgccaataaatgtactgcaccagaatacggcgttgtagtcttcatgcctgatttccttcagattgaccaatgcggcacggaatccgctttcttgtaatgagtttcctattaaagtaaatatcgtaagcatgcctaccataccatattccgacggagagagcaagcgtcccagtatgataccgaatgctaagacgagaacctgttgaacgccgttgttgatggctccccacaaaagtccttttgcggttttttctttcagtgattgttcgggcatgtcacaatattttagaataatggatgtgggtagtaatgaaagcgaagaatctcaaaagagtgaaatttgagattcttcgcttgagtatagtttaaaaagaatattatttcacttcacttccgggttttacttctttcagtacagaagtaacggcaagtgaaccgtcgaagttctcggcagacagaatcataccttcacttaccagtccgttcttgaactgacgtggggcaaggttggcgatgaacaatacctgctttcctaccagttcttccgggcgatagtgctgtgcaatgccgcttacgattgtacggttttccagtccgtctgcaatcttgaatttcagcaatttcttcatcttaggaactgcttcacattccaatacggttcctacacggatatcgagcttttcgaattcttcgaatgcgatagtcggtttgataggattagccttgtagttggctgcttcattagcttttttcgtagcaagcagtttgtctacctgtgcctgaatggcgtcatcttcaatcttttcgaacagcaattccggcttgttcagctgatgtccggcagccagtaagtcggtgcgtcccagttgttcccagtcgaagctttccatattcagcatgtgacgtaacttctcactgctgaacggcaggaatggttcgaaagcaatagcaaggttagcaaccaattgcagagcaatattcaagatggtagctacacggttcatatctgttttggcaagcttccaaggttctgtatcggcgaggtatttgtttccgatacgtgccaggttcatcgcttccttctgtgcatcacggaacttgaagacattcagcagtttttcaacttcagcttttacgtcggcaaattctttcagtgtttcacggtcgtagtcattcagctcaccgcaaacaggaactttactttcaaagtatttgtttgtcaataccatggcgcggttgacaaagtttccgtagacagcaaccaattcattgttgttgcgtgcctggaaatctttccatgtaaagtcattgtcttttgtttcgggagcattggcagtcaaaacataacgcaaaacgtcctgtttgcccgggaaatcttgcaggtattcgtgcaaccatacagcccagttgcgtgatgttgagatcttgtcaccttccaggttaaggaattcattggcaggaacattgtccggcaaaatgtaacttccctctgctttcagcatggcagggaatacgatgcagtggaatacaatgttgtcttttccgatgaaatggatcagacgtgtttcagggtctttccaccatttctcccatgagtcgggcaataattctttcgtattcgagatgtaaccgataggagcatcgaaccatacatacagtacttttccttcagctccttctacaggaacaggaataccccagtcaaggtcacggcttacggcacgaggctgtaatcccatgtccagccagctcttgcactgtccgtatacattaggacgccattccttatgatcttccagaatccatttacgtaaccagctttcatgtttgtcgagtggaagataccagtgcttggtttccttcatgacgggctggcttccgctgatagcactttttggattgatcagttcggtaggagaaagtgtacttccacatttctcgcactggtcaccgtaagcaccttgtgtgtggcagcgaggacattcaccggtaatataacggtcggcaaggaatgtatgagcttcctcatcgtaatactgcatggaagtcttttcgataaattctcctttgtcatacaatttacggaagaaatcggaagctgtatcgtgatgaatttttgaagaggtacgtccgtaaacatcaaatgaaattccgaattccttgaatgagtcacggatcaacgtatgatagcggtctacgatatcctgtggagttactccttctttctttgcgcggatagtgataggtactccatgttcgtcagaaccgccaatgaagagcacatcttcttttttcaggcgcagatagcgcacgtaaatatcggccggtacgtaaacacctgccaaatggccgatatggaccggaccgttggcataaggcagagccgaagtcacggtcgttcgcttgaattttttttccatatacgtatatagtttattttgagttgcaaccttacgatgcgcaaagataaggattatttgggaattatcatggatagaaggaggttaagcgaacattctcttccctttttatccggattgtattttcattgcaggaaagatagaaattttcttaaagagtttggaatggcttggaacatatgatattgattgttgtttaaattgcttagcagactgtagctgattgaatttgttgcgacctttttgtagattttttattatcgtacaaattctttataataatgacttgccatacgataaatctatgtaattttaactgttggaataattgcggaaatttttttcgtgtttcttagttttatgaattgattttcaatgatttgttaaatattaaatttgatacaatgaaacatctgattttagtaggtatggtgtggctatgtagcttagtttcggttgtagctcaaagcgttccacaagtaatccctgcgttgcagcaatggcaaccagccaaaggtaaactagtcttgccggaatcgggcaaagtgattgtgtcctcggatgaggaaggaatattgaagcagagtgctgaaatattagtgcaagatttgaaagaaatgtttggctggaattaccgtgtggttgttggtaaaaaggagaagggagctgtttatttgacattaagtaaaccggacaagacgttgggtgacgaaggatatcggatggatattcgtaatgggataaccattgaggcgcctacttccaaaggagtattttggggtacacgaaccttattacagatgattcataatcagccggaagggttaatgaagggactcgccacggatttcccgttgtatccgaatcgtggatttatgattgatgtagctcgtaagttctttacgatggattacttacgtgattatgtaaagattctttcattttataaattgaacgaattgcaggtccatttgaatgacaatggatttgtagaatttttcggaaatgactggaacaaaacgtatgcggctttccgcctggaaagtgaacgttatccggggctgacggccaaggatggttcctatacaaaggctgagtttcgggattttcagaagatggcagctacttatggggtcaatgtgattccagagattgatgtgccggctcattctttagcttttacacattataatactcgactggcagctgataataaggcgtacggtatggatcatctggatttgtataaaaaggaagtctacgattttgtagattctctcttcgatgaatatttgtcgggtgaagatccggtatttgtaggaccggaagtacatatcggtacagatgagtataatgtgaacgagtctgaacagtttcgtcgtttcacaaatcattgcatggatttggtagctaaatatggtaagatgccgcgtttatgggggagcttgaaaataatgaaaggagaaacgcctgtcgacttgaaaggaaaggtcgtgagtgcctggaattataactggatggatgtgaatacgtgtctggaagcaggggccaaagtggtgaatctttgtgactggcttttgtatctggtgccggccgtaaattattatcatgattttttggattatcaatggttatacgaatcctggatgcctgaaatgatgaggaaggacgatccaaaggttgaaaagcgtaatccaaatttcttgggagctatgttagccgtttggaatgaccgggtaggtaatggaattagtcaacaggatgtgcacgcccgtacttttccggcgttgcaggttgtgtgtgaaaagatgtggaaaggtgaaaatgtacagcatgtatcgtatgctcagtttgaagcactttgtcagtcaactcccgaggctccgggcgtgaatttgctggcgaaggttcctcggcgtacggtattaatggatacagataaagagataacgctttcgggtacggatgtagtgacaacttctgtcgatgagatcggttatccttatgccgtagagtttgaaatttgtccggattctattccgaatattgatgctgtcttgtttaaggggcctcattcagaattcgtgaccaactggcaaaatacaggtaagtttgctttccgtcgtgacgggtatgaatttgtatttcatgcttatcgtttgcctgaaagcaaatggacaaaagtacgcgtggaaggtgatgtaaaagggacttccttgtttatagacggacaacttcaggaaaggttggaaggacgtataggtgaagtgtttaatgcgaaaagtcagaaaaaagaccgcatctggtaccaggaaacgttaatattcccattgaagcaattaggagatactcaaatgggatttaagggaaagatgaaaaatgtagtatgtattccgcgttagtatgctttctgtgacttaaaaaaaacggctatctgaaatcttcacagacttcggatagccgtcacattcaatcgtgaattagcctttccccaatccccatttcatagccgcaaaggtaagttgttgttttactttgtagcggcattatattcagatgtgagagaagcaagcaaatgactgtcaaaattccctttgtggagaaatgtcttcatcacattcttcatagagggttatttcttcagtatattgattggtgcctgcaaatgcagtatatcgtgtgttttatctactccactggcaacctctacgtcttgtgttgctttaatgtcgcgggaagaagatcctattgaaaacttataagtacctgaatcggttacccatgcagaagtactttcattgtaagaagccagatcgaatgtcttgacagtcattgtaacagatgtcgtttcgcccggtttcaattctttagttttggcaaaagccttcaattctttttccggtttgttcaagtcacctccttgaggagcagaaacataaagttctacgacttcttttcctggtaatttgcctgtattcttgacatcgactgtaactgtataggttccgttttctgccttaacttgcggagttccatattcgaaggttgtatacgacaaaccgtatccgaatggataagaaacttgtttgccgaagctgtcgaagtaacggtaaccaacatagatatcttcttcgtaatcggtatagtcccataacttcacttcgctcttcttttctttcgggtcagtcatgttaagactactcatagctccttctgtcgggaagttagctgaagaggctgcatcctcaaattttacagggaaagtcatggtcagttttcctgatggataagcttttccgctcaggatatctgctacgctgttaccgccttcctgtcctgcctgccaagcgcagagaattgcatccggcaagtttttccatgaactggtttcgataactccaccgatattcaggataactactactttcttgcctgctgcatggaatgctttacatacatcgctgataagtttggtttcttccttagacaagttaaagtcggaaacctttctgtcgaggaattcacccgacatacgtcctaacgtaatcattgctatgtcggtttgagctgcgtagttgtttaactgacttgccggcaattccatttctgttggaagcggagttggtaagaatttaaccatcggattatctcctttaggtttgttgcgctcattctcttcggcaatgtatttctgataggtatcttttaactcttcattaacctggaaattcgcatttttcagtccgtcaagcagcgaaacagtatatgcacggtttacgttacctgagccagttcctcctgcaatgaaattgtaagaagtgcagccaaacaatgcgactttctgaatatttgaactcagcggaagtgtctgattgtcattcttcagtaataccataccctcggtagcagactgacgggtaattttggcatgagcctgcaaatccggtttgttggaataattgtatttcttgaagtgcggagtttgtagaatcatgttaaggatacgttccacgttgtggttcaatacggcttcgtccagtgttcctttctttacggcattgacaatggcctcatattgcttgtcgagtcccggctgtaacatatcgtttccagctttcatttgggcaacagcatccttacctccgaaccagtctgtcattaccatgcctttgaatccccattcatcacgtaaaagagttgtcagcaattccggattttcggatgtatagattccgttcaggtaattgtaggaagacatgacagtccacggattggcttcctttacagcaatttcgaatcctttcagatagatttcacgtaaggctctgggtgatacatgtgcatcgacagccatacggttgctttcctgattgtttacggcaaagtgtttgatagatgtacctactccgttgctttgtacgcctctcacataagccgcagcaatttttccggaaaccagagggtcctctgagtagtattcaaagttacgtccgcacaatggattacgatgaatgttcagtgctggtgccagcaatacgtcggctccatactccagaacttcatttccgatggctttacccacattctctaccagttcctggtcccatgtagatgccagtaatgttccgatagggaagtgtgtacagtaataagtggcagagtcaccttcacgggttgggtcgatacgcagtccggcaggaccgtcggccagtacgacagccgggatacccagtcgttcaatgggataagttgttccggcagcaccgggaacgagtttctttgttttgccgataacagcactatcacccgagaagccagccattcctgtaccgactaccagatgagctttttcttccaaagtcatggcattgatgacttcatcaatcgtggcctgtcccagttgaggaactttgggaccacatgaatttaatatcatggctgaaagagccattccaagaatcaattgctttttcataattagtttagattatttgaacaataaaggtacaaattctgtcaggtatacacgccaatttctccagatatgtcctccatcggtttccatataagtatatttgtaccctttttcatccagttttttacggaaatcagtattatccttgtaaaggaaatctgtcttaccgatacctatccagtacagacgaggtggattgctgaactgggtagcaagcttctggtcgatattctgatatacatccgagatattattctttggatctatttgtttgctggttgcagccgagaacaaacctacataaccgaatttgtccggatagtatgccgagatgtagagtgagtggaagcctcccatagacaatccacagatagcacggttgtttttatctttctttacacgataggtcttttcaacaaatttcatgatatcagggaaggccttttcaatttctccgtccattgttttcggattcatgaactgaggcttaaccatgctgttaggtgccgctcctggagctgcctgctgtgcaccgtttccgttcggcatgacgacaatcatcggttctgctttaccctgagcgatgagattatccataatctgggctgcacgtccttgctctacccatgcgttttcatcaccaccggctccatgcaacaggtataataccgggtatttcttactgctgctttcatatccggcaggagtataaaccgtaagacggcgttccatacccaacgtcggactgctataccatactttcgatacggtgccatgtggcacgtcttgtaccatgtataaatcggcctgtccgtttccaatcaggaaatagttggtaatggtggcaatgtcacggttctgatagacattgctgggatcggttgttttgaaatcgtttacatagaccgagtaattgtacatttcgctgggcaataccgatgaggtatattcccataccccgtttttaccttctttcagctgcactcttcccggagcctctacttcgccgaacggtgtttttattttctgtgtaggcaggaaatctccttcaatttctaccttcgaagctttgggagccagaatacggaaggttacagaattatctttgtttatctgaggggagacgatgtcgcctccaccccataaagcttgttgtgcatatccagacaggctgaataacaatgcacttgcatataaaactatttttttcatacgtgtaaatgtttttagtttattcaaattaccatcccgggttttgtgtcatattcgggttcagtgacatttctttttcaggaatcggtaagagttcgttcttgtttttcgtgaagccgtaaccttgctggttgacgaaaccgtctttcttaacaacaggatctgctgaagtcgatttgtccattaccaatgatggtatataatgtcctttttctttcagtaccgtttctgcatctccccagcgtatcaagtcctggtagcggacaccttccatgcacagttccagacgcttttctgttttaatatcatccagagtaacattagacaatggagctaactgagcgcgttgtctgatttcattgatatagttcagagccttgtcctgtccgcttcctgcctgtacatgagcttcggctgccatcagtaagacttctgcatagcgcatgaagcgcaaattgatgtattgatagaactgaagtccggggttatcgtacatacagtcttctttcagagcgcggtatttccatgaaaaatagccttcgttacctaccatgatgttaccgtctcttaatgagattcctaaactttccaattgtttataggtaatgatagtctggttcaagcggtaaccatcggcagtttcttcagctacaaatgcatcatacagtgattttgtagggttaccgaaaccgtagcagccttgtgaaaaggctgaggccgactggtcaaaattgagcattgaggaacgccatcccagcatacaatatagctgagtaaactggttccacatttgttcagggtcattgcgcatctgtgcttccagaatggattctctacaattgttggctttaacgtgtgcaagatctccgtagtcaccctgatacaacccatatttgccggaagcaattactttatccagaatattggcagcttcgctgtattttccctggaataggtaagctttacccagatatgccatggcagcttcctttgttactctgatggttgttacatcatcgtctatattctcttttgacggcaggtcgctggctccatcgggatctcctacggctgcgttcaaatctgattcaataaatgcccataattcttctaccggcgtatttcctttcctgtattcatcggtagtcaacagatggtctactttaggtacgcttccccataaagtaaccagttcgaagtatgagaaagcacggaaaaatttagcttcggcaatggcccggcgcttgacttccgtatccggtgctactttgtcaattatcagattggcattgtatacgatagtgtataaacctgaatacagactggtaatcataccgtggtctgaaccgaatgtcatttcgttcaggcgttccatttctccgttatcgcctcgtgaacctccacctgtatacatgtcgtccgacagcaggttctttacaaagaaccagttataatgttgtgatctgacagacagatacagagccgcagcagcagattctgcttcatcgtctgtctggtaatatgtttcctgacttcctacatcaccatgttttgcaatattgagtctgtcttcgcatccggtagtcagtgtcatgcaaaacattcccgcagcaagtgctatatatagtttctttttcataatataattcaattaaaattcaacattaaagcctaacataactttctttgcgcttgggtaggtacccatatcaatacccataccgcttgtagcgtttgcagaagcttcaggatcgaagcccggataactggtgaaagtaaagaagtcttccagcgatacatacaaacgcaggttgttgatgaatactttgtttatccattgtttgggtaatgaatatcccaactggatttgtttaattttgaaatatgatccgttgaataccattgcgtcggatacggtatatttatccagactcagggcattggctctcggagcgctggcgttggtatgttccggtgtccagcggtctttgtagaatacttcactcagtttgtttgctgaggcatggtccggacggttgatgcaactgaagatatcgtttccgtagctacctgaaccgaatacggtaaggtcgagacctttccatgcagcagtcagtgtgataccatatgtaaagtctggaatggcatcgccgatgtaagttttatcatcttcgttgataataccgttgttgtccagatcggcaaaaatcggttctccatcttccgggttgataccttcgcagtgataaccgcggaagtagtaaaccggatatccttcttcgaaataggtaattgtatttgtatggaatgtagttccactagctctggtaagtgacggatccagataagtaactttgttcttcaaggttgccagatttcctttgatgctataattgaaatcaccgatgttatctctccatcctatttcaaattcaaaacctttgttgcttacattaccggcattgatcggtgaagttgttccgccaataatgagtgaaggagttgtaccagtgataagcaagtctttagtcttcttgttaaaccagtccatagaaagagtcaggcgatcgttgaataaacgagcatccagaccgacgttgatttgttcagaagtttcccatttcaattcatcgttacctaagctgttcggacgaatacctgttgtatagttattacctggaacgaacggataatatccggctgttaccatggtagttccgtaaccgtaaaggttgcttgctaatgcagcaaggctaccattctgtccccagctggcacgtagtttcaggcttgatactacatctctcaacggagtgaagaagttttcttcagagatagtccatccggcagatacggcagggaagtatccccagcgtttttccaaaggaaggtaagacaaatcggctgcatcggcacgaagtgaagcttgcaacatatattttccggcaaagtcatatcctacacgtccgaaatatgaatatttggctgtacgggtcttttcaccttgtattgatttacttgctgaagggtctccataattcagataccagaatgacggatctctgttggtgatggcatctgctccgtttgcgctgaatccactggtaatgtagtcgtatgtagattcctggtaagacatacccaacatggcgttgatggtatgtttatcgaaagtcttgatgtagttggcgaagttttcccactgccaatagatagaagtgcttgatgtaccgctgatagacatataatcattgttctgaacagagttgccgtaaaatggcaggttgactgttgaagaacgagtaccagacaagcggtaaccgaaacgtgaggtaaatacgaatccgtcgaatggtttcagttctccgtatacagaaccgtttacattgaatccactgtttttaggtacagtattatcgcgcataatcatcggatgataattctccgattctacaaagttggaaactgcatagtaatttccgttttcatcggtcagcagtgtcttgccgttatcgagtgcagcctgcatgttagcaggaaggttgtcaggactatatgtgctgggagtcagcgggtcgagctccatgacagcctggaagaagctaccatacgcattattgcccgacagtttgcggtaattgtatttttcaatctggttggttgttcctacttttaaccagtctttaatctgataatctgcgttgacagaacctgtcagacgtttgtagaagtctgcatctcctctgacaataccattgttgtccagatatgataaagaaagataatagttccctttttcatttccattagagaatgacacgttatgcttttgcatctggcctttgccaaatactacatcagcccagttggtatctgtaacaccatcccagtcgttgttaatctttgactgttcgaatacgtcaccttctaccatgtatgtagcatattcctctgcattcatcagcttcggcattttgccaagtgactgaatggagtactggaagtcgtaaacgacttttccttgtccggttttgccctttttggtactaatcagaataacaccgttaccagcttctgcaccatagatagcagctgaagctgcgtccttcaatacttcgatagaggcaatatcattcgggtcgataccggaaatgtcagaaagacgtacaccgtctactacataaagagggtctgaagccacatttgaagaaaaaccacgtacacggatggtcggtgcttcccccggagcagcagaggaagaaattacctgtacgccggaagtcttaccttgcagtgccgactgtaccgtagtaacggaacggttttccatatcttctgcttttacttgcgagatagaaccggtgactgaactttttttctgtacaccatatcctacaaccacaacttcatttagcgtctgtgtatcttctttcaaagtaacattcagtgaagactggtttacaggaagctcctgagttgtataacctacataagagaatacaagaacatgtcctttaggaacattcaatacataattcccgtcgaagtcagtaattgtaccgttggtcgtacctttttcaagcacacttacaccgattaaaggttctttgctctttgcatccagaacctgaccttttacggtaatactttgcgccaatgcagatgatagtcccatccacataaccagaacaataaaggcaatcgctctggtccattgtttgtcatttgtcttttccatatagttaacaattagggttagtaattagaatcctctcattggaaattttgaaatgaactgcatcagttctttgtcttgattgtatttgatctcgctttggttgttgaaaatcattgttgcacctttctctactgtatacggttcccatgttggaagaccttctacattaggatttcctgtacgtgcaaactgtatccatgcactgctcattttgtctgccagtgcttgtgcatctttacctccacctgtcattgaggcgcatcgagcgatgttgtcgaaaacaaaagctatttccatgcaatgagtagaacggagaattccatccattacgggtgattcccatgcaaactgatacatgtaaacaggagcggcgtgctgggcagctttccagtttccttgttcgattgctgctggacggaatgttacgtcaaaatcgatcatgtcttgaggagtcgcagccggatatacttttttgaatatttcgatatagttatcggtcttctctccatatttagctttcagcatttcttttgcctgatcaagagttgcatttctcagttcgggaacatatgtactgatacagaactcatgtaaggttgtaccgatcatcattggaatatcttttgataattcggcttgcttttcgggctgttgggggaggatgtttccgtcaacggtaggtccccatccgaatataaaagaatggatgccttctttttcggcttctttgcggacattggctattgctttttcgcctgcagccagtaatgttttataaggtatggtctgaagtttatcaatctcttcagctttgatactcagttcttctaatgtagccgcagctatcctttgagagtatttgctttccattgtccgctgcatggaaccactttgtacgatggctttttggaaaagaccttttgcagagggagtagcgagtagtgtagatacttttcctccgccacctgactgtccgaatatggtgacatttgatgggtcacctccaaagttttcaatattttcgtttacccagcgaagtgcagctaccagatccagcaaacctacgtttacactttgggcatacttacctccgtaagctgataaatcgagaaaaccaagtacgtttaatctgtggtttaaggtgactactacgacatcaccctttttggataaagctgctccatcgtaggaaggtaattcctgtcccgaaccagctgcataacctccgccgtgaagccataccatgacaggacgttttttgccatcttttaatccttgagtccagatatttacgcgtaggcagtcttctccaggaaaaccgtcgtcccagttgaaagcgaatgcttgttcatccgactgccatcccatacgttctgtctgcggacaggtaggtccgtaagctcgtgaactacggatgccgtcccattggtcgggggctacgggtggcatgaaccgttctgctttagcgtagggaatacctttaaaggtaaagatattgttttcaaggtaaccggccactttcccatattgggttgatgtgatggcaatattcgacgatgcggtgatttcatcacaaggttcattgtatttgttggcagcatgtatattgccggcatagagtccgagcactgccatgaaaatgaaggtaggtaatttgtgctttatcataggtttattgttttaggttttccgtttgcaatattacgatgttcttttctctacaattattttatttatttttaaagtttgtttttacgttcagtggccttgttttatttgtttaaatgtttatctaaatgttcaaaaactgctttgcagatattttccgcctcgtttttttgttatatttgtatctgtaaatttgttaactaatagtacttaaaatgagaatattaagttttctgtctttcctttttttattgctttcttgcggtaaaacagagaagaacttgcttacagatacggaaaggcaaagtccccttgttacgaatgatatatccaaccagcagattacggcattcggtgaagatgaaaaaggccatgtctggattggcacttttcgcggattgaataaatttagtgttaacgagtatcatcaatacttttgtacggacgattctcttgatattcccgacaatcatattcaagatatctttctggattcaaaaaaacgtttgtggatatcgacagtgaacggaatctgtctgtataccgatgaagataacttcaagaatattcgtttgagtggaggaaacaagaatggcattcgtatctcagagtcttccaagggaaagattctgttgacgacgatgagtaatatatgcctgtatgattcactggaggagcgttttgatcctgtcgtttatgattttgatacttcgtatgtcttcaacagttttctggatgcgcaagataattgctgggtaatcacttccaaggagttacggtgttattcgttgtctgattaccggagaacattttcgacggcatgcgatgagttttgtcatagcgcctatttgtttaaaaatggggaactatggatagcgggaaaccagtctttatctgtattcgatgtgaagcaacgtaagtatgtggctttacctgcggcaatcgcttcacatccggttttatctcatgtgcctgtcgattatgtctacccttacgaaaatggtgtcttgctctgtacacagagaaaaggtattttttattacgaccggactacaaagactgtcattcatcaaggagaaaacggtttcccttttgaagtgccgaattttaagatcagccgtatgtttagcgattcacagggaaatttatggattggttcagtcgatcagggatatgttgtacattatcgttataagaagctgttcaataataatagttatcttagttccttttttaaagataaatcggttatctcgctgtctgctgataaaaaacggaatctatggattgctactttgatggacggaatatatgtctatcagtttgccgaccagcggctggaaagaatcgagcatcatgaactttttcatggaaatgaagaaagtacggcctatatcaatcaggtgtatgtgagtaaggtagatgaaaccgtctggatgacaacaacttccggagaggtcctaaggtgtagctatgaaaatggagattttcgggtaaacgaacgttatccggttgttatgcccatgtctatcgtagaagatgaaaagcaaacgatatgggtaggctctgccagtcgttttttatgtatattgcctaaaggagataagagttttcataccttacctgtttttaatggttatacttttattccgggacttttacctgtgggcgacggaaatatgttggttgctgcattcaacgaacctttggaattgctttcttccgatggaaagcaatatggatttaatatgaacaagcaggattttgagcgttgcatacgccgttctgtctttattccgaccgatttatataaagatagctatgggcatatatggattggaatggtaagtaacggattgatgtgttattctccggagtcgggaaaggtaacttccttgccgggaacagcttgtacagatatttccagtatagaggaagacaagcagggaaatctgtggataagtacattgtacggactgagcaagtatatgcctcagacgggtaagctggtaaattattatgaagccgacggattgggtggcaatcagttctacgacagagcttcgtgtcagttggatgatggtacgcttgtgttcggaggaactcacggactgactattttccagccaaccgacatgcgggtcagacaccatattccgttactttttgaagatataaaaatacataatgtgctggtccgtcccggaaagggtgcatgcatcgaccgccatttgtcgtataatccggatattaatttgaagtacgaccagaatggcttcagcatctcgtttgcggcactcgattatagtgagagcgagcgtatgcactattattataaactggacgggttcgaccggtactggattgatgcccataataataaagaggcttattatgctaacttgcctgccggaagttatactttccgggtcaagattactcggaacgaccagagcacaattgtcggggaaaatgctatccgggtgataatgcaccctgctccctgggctacctggtgggcttattgctgttatctgatagttggaattgctatattgggattctttataagagatgtcaaacgaatccgtgcagaaaaacaggcggcactgcttgccgaacgggcaaaagagcaggaacaattcatcaataagatgaatatgagtttcttcgccaatatatcccatgaattccgtacgccgctcaccatgattgcaggtccggtttctttattatatagtagtccggacattactggcaataacaagaacttgctgcgtattgtgcagcgtagtgtaaaccggatgctgaggctggtaaaccagatgcttgattttaacaaactggaaaacgatacactgaaattgaaggtacgtcctaccgaagttatcgtcttgttgaaagaattgacggatattttccggattaatgctgaaaataaatctatcacactggctaccagtggactggaaggcagtttcattgcttggatcgatgaggataaaattgacaagatatttaccaatctgatgtcgaatgccttgaagtatactcctgtaggtggacgtatttatgtgaatttcgatgtcatatcgggagaggaaggtacacagtctataaaaatagaagtaatcaataccgggcagattgcggaagacaaactggagaagatattcgaacggtactatcagatttcggatgagcatggaggagtatataactggggtacaggtattggactttactatgcgcgtagcctggctaaattgcatcatggtactctggtcgctgccaatttggaaggtgagaaaaaagtggtatttacgttgaccgtaccggttagtcagtctgcttattcgggagcagaacgagctcatgaacaggttaaccagttggaagctttcccgttggaagataatacacctccagtgaagcctgttgcagaggccggtaaggagaaaaagacaatcatggttgtagatgatgattccgaggttgcttactatctggaaatgctgctgaatgccgattatcaggtaatctgccggtttaatgcggaaagtgcattggaagccattaccgaacatgcacccgatttgattctgagtgacgtagtgatgcctggaaaggatggctactggctttgtcgggaagtaaaggagagtttgcagctctgccacattccggttattctggttacggcaaagacgactatcgaaaatcaggtggaaggactgaatgtcggagctgatgcgtatgttacgaagcccttcgaaccgcattatctgctggcacttattaaatcgttgctcaataatcgcgaaaagacacgtagcctgttaagtcagtctacaaagacggataagatagaggaaaatgtactgtcaccacaggataatgcatttatgacagatctttatcgtctgatggaaagcgaattgtctaatccggaactggatataacgcggatgactcagttgctgaagatatcgcgtacgaagttttattataaggtaaaggggctgaccggagaaaacccgagcgttttctttaagacgtataagctgaaccgtgcggctgagttattgaaagaaggcaagtatacgatttcggaaatagcggatatgacaggtttcaataccttatctcatttctcaaaaagcttcaagcaacagtttggtattccgcctagcgaatatctcaaataggatgaggataagttccgatagtaccggcatgcttgctgaatcttttgtacaaaagatttttgtttttgtacaaattttcagaaaatatgccggcatgttgaagctaatatgccgcgatttgtttgtatataaagagttttagtagcctttttagcccttcacacccttcacggggttggtttcttttgcctttctttgccggttaccttgtttaatccagcgggttttttctattctggagggagcgggtgaaggccgtgaagggctaaaaagccatttttttgttttgaaataacttgcaggagggtattatcgtttggtcttggctatcataaaagttatggcagctatggaaagcaagatacctacaatgatatttgttgtgagtgcttctccgaaaacgatggttccaataaggatggctgtgatgggttcgaagacccccagcacagaagctttggttgctccgatatttcgtgtggcaattgccaatgtcgcagtggaaaccacggtaggaagaagggcaagaccgacgaggttcatccaggccatgttgtgattgattccggctgttatatcaatatccgatattataattttccccagaaaaataatggtaccgactgttaaggcataaaacgtcagcaggctgttcgatatgttactgattgttttgctccggttgatgatgacaataaacaaggcataaaccaaagctgagcctaaggacaggataactcctattgggttgatggtgtgtgtggaatcactttgtgtcatgatgactactcctgcaaaggtgagaataatggataaccagacaggccaggaaggtactactttcaggaaaaccatgatgattgcaacaagaaccggataaaggaatatgatggtggtggcaagaccggaggcgatatagttgtatgcttcaaacaggaatatgctgctcgaagtatagagtaggccgagaaccagtaacacaccagcctcttttcgggatatcttgaaactttgtttgcttaataaaaggaataagcctaaaaatagtacggcaatggcatatcggaaaaataggattgattcgattgctgccccgtttttcattaatggaacaccgaacaaggggttcaatccgtaggtgatgccggtaatgattccagccggataaccgataattgcatttctactgatatttttcatattgcttgataagtagttaattggatatgcgtaatatttgtctttgtttgttgctattatgttctgcgttatcctgcccagttttcccggtctaagttacggtagctgattgcttctgccaggtgatgggattgtatctgtgcagaatcttccaggtcggcaatggttcttgaaactttcagaatacgatcgtaggcacgtgccgaaagatggaaacgttccatggcattgcggagcaatgtgaggcctttttcgtcgggtaatgcatactggtgcagtaaacgtgacgacatttgtgcgttgcaatggatgcctgcgtcgtgtgcaaaccgcttggcttgtatctgccgtgcccggatgactcgttcgcgtatggccgagctcggctcaccttttgcctgttcggataatttttcgaaaggaacgggtacaatttctacctgtatatcgatgcggtcgagtaggggacccgagattttattcaggtatcgttgtacttgcccgggactacagacacaatggcgtgtgggatgattataatatccgcaagggcagggattcatggatgctatgagcgtgaagctggccggatattccaaagtgtatttggaacgtgagatggttatgcgtcggtcttcgagcggctgacggagtacttcaagcacactccggttgaattccggcaactcatcgaggaaaagtacaccattgtgtgccaggctgatttctcctggctggggagtacttccaccgcctaccatggctacttgtgaaatagtatgatgggggctgcggaatggacgtacggctatcagtgaggagtttttgccgagttttccggctacggagtgtatcttggtcgtttccagactttcggcgagtgtcagtggcgggagaatgcttggaagacatttagccatcatcgatttgccacttccgggtgcacctatcatgatgaggttatgacctccggctgcggcgacttcgagtgctcgttttacgctttcctgtccctttacatcggcaaaatcgaacggaaaatcggtttggctccggtaaaattcttcacgggtattcacaagagtgggttccaaggtacggttgccgttgaagaactcaatgacttcggtgatattttctacgccaaaaactttcaggttgttgacgactgctgcttcacgggcattttgtttgggaagaatcaatccctccagtccttgctcgcgggcacagatagcaatgggaagtgctcctttgatgggttgtagagtgccgtctaagcccagctctccaatgaggagataccggttcagcttttcggatgaaactgttcctgttgcggccagtattccgatggcaagaggcaggtcgtacgatgatccttccttccggatatcagcaggtgccatattgactacaatctgacaggtcgggaacttataaccgtttacctgtaaagccgacaagatgcgttcatggctctcttttacggcagaatcgggcagacctaccagaaagaatttgatgcctcgtgagctgttgacttcgattgttacgatggtggcgtcgataccttgtacggctgcgccaaataatttggttaacatgaagatgggtgttttttatttcttctcttcttgagtaagctgctttacttttgtgtaaagggcttctccatacagatctttatcaatgactttccgattacgatctatcaggatgttggttggcagcttatcaatattgttctgttttacaacttgattcccccatcctttataatcgcatacttcaatccattgtttgctgtcttctttacaggcatcgagccatttctttttttcataatcgagagaaatattgagcaccctgaatttatcttccggtaatttcttaaccattccggttagagagtcgcggatagccatacttgtcttgtcccagctggcccagaaattcaggagggtataactgttttctgttgaactgctccaagtgatatatttcccatttcggtccttacacgaaaaataggcaaggtatttttcatctcgttcgtttttatcctttgcgggcattgatttcaatacgactcccaatacacggctgtcttttacactaccccctagcggatctatcaggctacggattttttcaatgtcaggttggggaacctgtacaaagtagtcgttgataagatatgcagaaataaatgattgcggatgaagtgtgataaattcttctgcttttttggaaactgctgtacgatcgtccttgatgtcttgtatactttccaaaaatttgccgtactctccattttctccgtcaccactaataaccggattgtcgaaagtccctgtcagattcatgtgcaatgacttatctgcaacgaccggtattgtttggccattgtccggtgataccaggcggaacaaagtcagagtatcgggtgcaaatgtataaataaacttcccgtttttaggaacgattgtatcaagtttggaaacaggatcatcgtatactaccagaatctcatcggaagggtaatcctggagttctgcctgcaagacaaattcaggtttctttttgcaggaaatcaggccggttacagctataaggaagaataatatttttctcatgtttccgttttcttttctgcgaaagtacatattttatttgtaataaaaaagccggaatacaatggaatgtattccggcttttcaaaagatatgataaaatcaattatttgatttcattagcatatttagcaaattcgcggtcgttctgagcttttgcagccagagttgcatctttctgagcaaccttagccatgctagtcttaaccaagtctgcattgtttgttcttgcaccaacgatagccatcaggtagtcagtgtaagcatcaggattctgaactgcattcaaagtgtttttagctttgttgtagtctttagccaggatctgagccaaagcagctgagttagtcttagtgtcaccgaatgcctgtacagcgcggtcgtactggccttgtttgatatacaagttacccagagcttcgttagctgtgttagcaccagttgacttgctcaagtaagtttcagcgttagcaacgttacccttaaccatttcgatgtaaccaaggttagtgttaacttcaggagcgttagcattcttgctagcagcctgtttgaagtagttttcagcagcagtgaagtcaccgttagcgtaagccatcatacccaagttgttgtatgcacggaaatcgttaggatagagttcagtagttttcttgtagatagcttcctgacgagctttatcgtttgtcagagtagcagcgtacagcaattcttctacgctcaataccttagcatctgtatcgaatgcttcgttgatttcttcgtcgctacgaccgataacatcatagtttgcagtcaaacgagcacgacgcaactgaggaaggatttcgtcagccaaagtcttgtaaactgaagaaatgttcttgatttcagtttcacgctgttctggatcgttgtacatagaaagaacacgcaagatcaggtctttatcctggatgtttgatttagaaaccaattcctggaaaccttcccagtcctgagcagtgtatttagcatctacagtagtttcgatcttacctttcttcaattctttgttcaaatacttttcagtattgttctgacgatcttcagccaaagtagtattcagttttacaccaccatcaggagaagcgtaagcagaaatttcgatattgttcagcttgtagttcttagtatcaccagctacagtaacaacttgtttgttgaatgctttcaagctgtctgacttcaattcgcttgcgcgaaggttagcttgctggatcaagaacatgatctgagcttctttagcttgtttgatgatacgctggaatgcatccggagccaaagctgcgttagctgaatttacagtaggaagttctgaagtagcgataacaccatcagcaatctttacagaaggaatagtgtattcttttttacctttcttgatcttgaaatcaaggtacaattcagatttagccatttcaggaacatagtcgaaagaggctttcattgtataagtaccaccagtcttgtaagaaatagtctggtcgttgccttgtactttttcgccctggaaggtagctggctgacctttagcttcgccgccatcccatctcaaaaccggagtaacttcaacgatagcgttctttttgaagtacttttcagggaatttacccgtgatagtaacaggaaccttacctccaactgcctctaacacttcaggatttgttgtgaagtaatcagcggacaattcgcccatcttgctacatgaagagaaagcaaggactaacaatgccactaagggcaaatacaacttcttaatcatgattttttaatattaggtttgttataaaaattataatctagtcgttttttatcctcttttgggggcaaagataagaaaaactctattaggtgtggacgttttgaccttcttttttttaagagatattaaaaaaaagattaaaattcgctgtttttcttctctgatgcttgccgtttgatatttctggggtggtgctcaatgatttcttgtcgtaatctggtcttgtctatatgggtataaatttcagttgttccgatactttcatgtcctagcatacactgtatggcccgcaggtttgcaccgccttccaacaggtgcgtggcaaaggaatgacggaaggtgtgaggacttatttttttcttcagaccgatttgttcggcaagttccttgatgatgtgaaagaccatgattcgggagatgtttttcccgaaacggctgataaatacatagtcttcatactcaggctttatcagtcccgattctcgttctgttaaatagttcctgatctcattgatagctcgtggagatatagggacaagacgttgcttgctcccttttccttctacttttatgaagccttcgttgaggtataggtcggatatttttaagttgcagagttctgaaactcgaagtccgcaactgtatagggtttccagaatggcacagttgcgttgtccttcccgtgtgcttcggtcaatacttccgattaaagcatctatctcttctacgctcagtacgtcgggcaaatgttttcctatttggggggattccagcagttcggccgggtcttgccggatatagtcttcgagtacaaggaaatgatagaacgagcgtattcctgataagatacgtgcttgagagcggggatgaataccgatgtcatgtaggccggcagaaaaagtttccaggtcctgtagcgtcacattggcataatcgatgttctccagtgtcaggtaagcgaataatttatccaaatcggtaagataagcttgtactgtattgtcggaaagcgacttctctaatctcagatattgcttatactttattattatcttatcttttttctcataagttttcatttctttttcgtatctttgtcccaaatttttcaacaaaggtattaaaagttttagtttgaataggtatgagaatacaaataatcaatggtcccaatatcaatttgttgggaaagcgtgagccatctatttatggtgccgtttcttttgaagattatttggtgacactgagagcgctgtatcccgatgtgcagatagattattatcaatcgaacatagagggagaaatgattaataaaatccatgaaattggattctcttatgatggaatcgtactgaatgcaggagcctatacacatacatcgatagccttgcaggatgctattcgtgcagtaaccactcctgttattgaagtacatatatcaaatgtacatacccgggaagagttccggcataaatctatgatctcttgcgcttgtatgggagtgatttgcggcttcggactcgattcgtacaggctagcgatggaagctcttttgcatgtgaagaaataatacattagaatacatttagaataagaacaaaatatgatgctcaaacaaacaaaaatcgttgcgtccatttcggacttacgttgtgaagtagattttatcagagatctttttaatgctggtatgaatgttgtccgtatgaatacggctcacgccagtcgcgagggatttgaaaaattaatcagtaacgtgcgtgaggtttcaaaccgtatcgctatcctgatggatacaaaaggtccggaagtgcgtaccactgccagtgcagaaggtcctattgacttcaagactggagataaagtacgtattgtcggcaatccggcacaagaaactacccgtgaatgcattgctgtaacttatccgggatttgttcatgacttgtcggtaggtgcagacgttttgatagacgacggtgagctggagctgaaggttgtagaaaagaatgatgatacattgttctgtgaggtttgtaatgatgctacactgggaagccgcaagagtgtaaacgttccaggtgtacgtatcaatcttccttctttgacagaaaaggaccgtaacaatattctgtatgccatcgaaaaagatattgatttcattgcacattcattcgtacgtaacaaacaggatgtgcttgatattcgtgaaattctggatgcacacaagagtgatattaagattatcgcaaagatcgaaaatcaggagggtgtagacaatattgatgaaatacttgaagtagccgatggcgtaatggttgctcgtggtgacctgggtatcgaggtgccgcaggaacgtattccgggtattcagcgtaagcttatcaagaaatgtattctggcaaagaaaccggttattgttgctacccagatgctgcatacgatgattaacaatccgcgtcctactcgtgccgaagttaccgatattgccaatgctatttattaccgtacagatgcgttgatgctgagtggtgaaacagcatacggaaaatatccggtagaagccgttaagaccatggcgaagattgcagctcaggcagaaaaggacaagatggaggaaaacgatatccagattcctttgactccggaaaataccgatgtcactgctttcctggctaaacaagctgtacgtgcgactacgttgatgccgattcgtgctatcattaccgattgtttcagcggtctgactgcccgtaacctggctgccttccgtggtaaatatccggtattggctatctgctataaagaaaagaccatgcgtcaccttgcgttgtcttatggtgtagaagctatttacatgcctgaaaaagcaagtggtcaggaatactattttacagcattgcgcaaattgcttgccgatggagttctttcaaataaagacatggtagcttacttgagtggcggtaagaaaggtactcatacttcattccttgaaatcaaccaggtgggtgatgtactggatagtgaagatgtttatgtattacctaaccgtaaccgttacttataattaataatgtatgaaagaaacggacgctcttgatgagtatatacttcagcatatagatgaagaaggagattatctgaaagcattgtaccgggcgacgcatgtaaaacttctgcgtccccgtatggcttccggacacctgcaaggacgtatgctgaaaatgtttgttcagatgattcgtccgaaacaagtgcttgagataggtacttacagcggatattccgcactctgtctggcagaaggactggaagaaggggctatgctccatactttcgagataaacgacgagcaggaagattttactcgtccatggctggagaactctccgtatgctgataaaattcaattttatatcggtgatgcgctgaaaatagtgcctgacatggatgtggttttcgaccttgcttttgtagacggtaacaagcgtttctatgtggagtattatgagatgattctgaaaaagatgaactccggtggttatattattgccgacaatactttatgggatggtcacgtgctagaggctgaaccacatcacacagacacgcagactatcggaattaagaagtttaatgatttggtggcggccgatacacgtgtggagaaagtgatcttgcctttgcgcgacgggctgaccattatacgtaaaaagtaataattgatatggaaacaaccagacaaaataagattgcccggcttattcaaaaagagctgagcgatatattcctgttacagactaaggcgatgcacggagtactggtttcggtcagcgtagtacgtatcagtcctgatatgagctatgcgcgtgtatatcttagtgtattcccctcggaacgcagtcaggaaattgtaaaaaacatcaatgataacatgaaatccattcgttttgaactgggtaaccgggtacgtcaccagttgcgtatcattccggaactgaagttctttgtcgacgattcactggattatgcagctcatattgatgaattgctgaaaaaataattcttgttgttcaccacaggttgtatttgcttgtctttaaaaaagatgaggatatagcctgtggtgaaaaattaatatgccatgaatttccccttttatatagcccgaagatacttgttctctaaaaaatcacataatgccataaatgtgatctcaaccatttctgtttgtggagtggcacttgctacgctggcattggtgtgtactctttctgtgttcaatggttttcaggacttggtagagacgttttttacggcattcgatccgcaactgaaaattacggcagtccgtggtaaagtatttgacggacaggataagagagtacttcagttgaaaaagttgccggaagtagcagtctattctgaatcattggaagacaacgtgatggttcagtatcagggtagacaggcaatggcggtgataaaaggggtagaagataattttgaccagcttacccctatagacagcatacttttcggaaggggagatttgctacttcatgacgaggtagtagactatgcaattcccggcatccagctgctttctactttggggtcgggtatccgtttcctcgatccgctggaaatatatgctcctcgccgaggtgcgaaggtgaatatggcgaatccttccactgggtttgtgaccggcaatttgttttcatcgggtctggtctttgctgtaaatcaggagaaatacgatgcctcttatatacttacttccatgaattttgcccgtaaactgtttcaatatactacggaggtgagtgcgattaatctgaagttgaaggacggagctgatacagatgccgtaaagaaacacatacaaacgttgctgggtgacgactttcgtgtacaggaccgttatgaacagcaagctgatacgttccgtatcatggaaatagaaaagctgatatcgtatttgttccttactttcattctgatgattgcctgcttcaatgtcatcgggtcactctctatgttgattatcgacaagcgtgatgatgtggtgaccttgcgtaatctgggggccagtgacaggcagattgtacgtatattcttgttcgagggtcgtatgatttctctttttggagctttggcgggcgtgatatttggattgctgctatgctggcttcaacaggaatatggcctgatttcattaggcgattcggggagctttgtggtcgatgcttatccggtaagcgttcatgcttcggatgttataatagtatttgtaaccgtactgctggtcggtttcttgtcggtctggtatccggttcgtttcctgagcaaacgtttgctgaagaaataaacgccagtgcgagaatgtggtagtttgcaaagaaaaataaaaagaggccgtctcaaaatagaattgcaaaagtaaaaatcttatagattgaaacttagaagtaaaaaatctcctacttttagtcctgtaattgaagaaaacaaagactaaagtaggagatttttatgttgtaactgatagattataagtaaacctatctcagcttttcattttgatgcagcctctttttatatccaacggatgaaggtctttaaagtactgcttattcatcagcaagaacgaaatccagttgcttcttttccagattagcccgtgccactttgattttaacagggtcacccaggctgaacttacgatgatggcggcgaccaatcaagcaatagttcttttcgtcgaattcataataatcgttacctaagtcgcgcatggaaaccataccttcacatttgttttcgttgatttccacataaagtccccattcggtaactccagagataacaccgtcgtatacattgccgatacgttcactcataaattctacctgtttgtacttcacggaagcacgttcggcactggcagccgtttgttccatagcagaactatgttcgcacagttcttcatacttgtcggcctgagcactgcgacctccggcaagatagcgtgtaagcaagcggtgtaccatcaagtccggataacggcgaattggagaagtaaaatgtgtatagtaatcgaatgccaatccataatgcccgatattataaatagaatatcttgccttctgcatggcacgcaatgaaacggtttcaatcaggttctgttctttcttaccttcaatatcgctcaacagacggttgatagactttgaaacgtccgttttactgcctccagtacgtatcttatagccaaatcgggcgatgaactgactcaagttgtccagcttatccggatcgggcaagtcgtgtatacggtaagggaatactttcggtttcttgttcttgggaacttttccgatgtgttcggcaaccgtacggtttgctaacagcatgaattcctcaatcaacttatttgcttctttggaaaccttgaagtatacgctcagcggcttgcctttctcatcaatctcaaacttcacttcacagcggtcgaagttgatagaaccggcagccattcgtttatcccgtaaaattttggccagacgattcagttccagaatttcttctttataattgccttctcccgtttcgataatgttttgtgcttcttcgtaagtaaagcggcgattcgactttatgacggtatgacgaatccgatagtcttttacttcagccttttcgttcatatcgaagataacagagtaagccagtttctcttcgtcgggacggagcgagcagatgaagttacacagacgttcgggtaacatcgggatggtacggtctaccaagtaaacagacgttgcccgttttacagcctccttgtcgatgatgctaccctctttcacataatgtgaaacatcggcaatgtgtacgcctacttcccaaagtcccggtttaagctggcggatagaaagcgcatcgtcgaagtccttggcatctttcgggtcgatagtgaaagtcacgacatcacggaaatcttcacgttctgcgtaatcttcgggagtgatttcagccgagattttatcggcagcggcttctaccgattgaggataagtatatggtaagccgtattcggcaagaatggcatgcatttcggttgtattctcacctgccttacccaagatatcgatgacttcaccgaatggatttttagcttcttccggccattccgtaatgcggaccactgccttgtcaccgtccttgccacctttcagcttttccttcgggatgaaaatatcgtttgccagtgtactggtttccgttagcaggaaagcatagttcttgcttactttcagtgtacccacaaagtttgcattggcatgttccagtatttcaatgacctgaccttccacttcatggcgccgacgtttggcacacagtgcaattttcaccttgtcattattcatggcatgtgccgagttgcgttcagcaatgaagataggttcaccgccatcatcggggataaacgagttctttccgttgcttttgcgcaggaaagtacctgtcatgatctgccccttatcattcagtttataatgtcctttctctgtctctatcaaaaaattatcttctaccatttcctgaacgatgtcggcacaaagcattttcaatggatgtgtagtcaggtttaatcctgtaaataactgcttcaggctgaagctctccattggcttgatgcggaaataattaaccagcaattctgccagttctttcttcttcatgcgttttccgccttttttttctttctttttcttagccataatcgtaatattttatttactgccatctttcggacgatatttcgtacgcatatcaagcagaggtttcttttacaaagtaagcaaaataaatggaataaagaatcaataactcactatattttaaggtagaaagatgagaaactattatctttgtcgcatggagaaaaaagtattggtaaccggagctagcggctttatcggaagttttctggtggaagcaggattggagcgtgacatgcaagtatgggcgggcgtgcgcaagagcagtagccgacgatatttgcaggatactcgtattcgttttgctgaactggactttaccgattcagaccgtttggaagaacaattgaagaaacataagctggagcatggtggatgggattatatcattcattgtgcaggagtgaccaaatgtctggacaaggccgattttgaaatcggcaactattgggctacccgtcattttattgaaacactgatgcgtctgaaaatggttcccaagcagtttgtttatatcagctcgctaagtgtgttcggaccgattcgggaaaaagattattctcctatttgtgaacaggatgttccgcgaccaaatactgcctatggaataagtaagttacattcggaagagtatttacacaccatgaaagactttccttatgtcattttccgcccgaccggagtctatggtccccgtgaacgagattactttctgatggcagaatccattgcacggcatgtggattttgctgcgggattccgtcgtcaagatattacatttgtctatgtgaaggacttggttcaggccgtatatcttgccattgaaaaacaagttgtacggcgggcttattttgtaagtgacggacatgtctatagcagtcgtacgttttccgatttgatccgcaaggaattgggaaacccctggctgatacgctttacgtgtcccctggctttactgaaggtaatatcgtttgttgcggaaaacgtcgcccgcttgttccacaaatcgagtaccttaaatttggataaatataaaatcatgaagcagcgcaactggcaatgtgatattgccccactggaaaaagaactaggctatcgggcagaatacccgttggagagaggtgtaaaagagattattgcatggtataagaaggagaaatggctataaaactatttgaacgcgtagaaagtggaagggggctgtttgctgtagaaacaatcagtttgatatataacgctttgacatccttgctgatattattgctgtttccccgtatggaccatcccggcatgatgttgctggagcgtctgggtattgttattctgacgtttgtcctgatatttctgtatcaagcttttccatgtcgtctgacagcctttatacgtatgtctgtacagatgagtctgcttgcttactggtatcccgacacattcgagtttaaccgtttgtttcccaatctggattacgtgtttgctcacgccgaacagatattgttcggttgtcaaccggcggtagaattcagcaaacattgtccgtccatgtggttcagtgagcctttcaatatgggatatttcttttattatcccatgatactggttgtggtggtctattatttcctgaagcgttttgagtggtttgaaaagatttgtttcgtactggtcacttcatttttcatctattattttgtttatatcatgttgccggtggcagggcctcagttctattttccagctataggtatggataaggtgaatgcctgtattttccccgctatcggcgattacttcaatacgaatgactatctgattccgggtcccggatttgaacatggacttttctatcggttggtagaagcttctcaggaagtaggagagcgccctacagcagcttttcccagttcgcatgtgggaatttctaccattgtgatgataatggcatggcgtgtaaacaagaaactggcctatgtgctggcccctttctatattcttctttgctgtgctacggtctatattcaggcgcattacctgcttgatgccattgtaggctttgtatcagctttctttgtgtataatcttgctacgctgatgtacaaacgatggtttatctcaccagtttttaaactgatgggataaacacgcttattctccgaacgtttcttctatgtggtcgagtatgccgttcaggtcggccagtgtttctgcacgcagcatggcaatacgggtatccttgaagttgggaatccctttaaataaaggagatgctgccagatgacggcggacatgcaaaataccccggcgttcgtcgagcagattgacactgtcttgcacttcacggcgcagtacatccattttccatttaaacgatagaggagggagttcctcgccggtttgcaggaaatgttttacttccttgaagatccacggacgtccgaaactggcacggccaatcatgatggcatccaccccgtagcggtcgaaacattcttttgcccgttgtggagtggtgacatcaccatttcctataatcggaatgtgcatgcgtggattgttcttcacttcacctatcagcgtccagtcggcttcgccggtatacatttgtgcccgggtacgaccatggatagtcagtgcttcaatgccacaatcctgcaactgttctgccagttcaacgatgatcttgtgttcggcatcccagcccagacgggtttttaccgttaccggaatcttgacggcatctacgacagccttggttatttccagcattttcggaacattctgcaacattcctgaaccggctcctttgccagctacacgttttaccggacagccaaagttcaagtccagaatatctggatgagcctgttctacgatacgtgctgcttccaccatggtatcggtatcttttccatatatctgaatggcaactgggcgttctgcatcgctgatattcagttttaacatggtttttcctaccgaacgaatcagggcatcgctcgacacaaattcggtatacaccatatcggctccgaactctttgcatagcaagcggaatgcgggatcggttacatcctccatcggagcgagcagtacgggcttgtcgcctaaatctatatttcttattttcattgtaatattttatagggttcgactgcaaacaggtaagtaaagcttgcagtagatataaacagcttgttgaaatcgctgcaaaattaataaataaaagaaatcctcccaagcagaaggtattacctttcacttgggaggatttcatatgatagagctacggcttatcgatagaagtccaatttaggatgattgttgtacaaattttggttctgaagctcttctttttccggaatgcggaacagataatatttactgttcgcctcgaagtctgattcatcaggaaattttagagtagaatgtccacttataagcatacagttctgttctttattttcatctattgcatttttaggagctagaattacatcaccgttctcatccagtttaggtgttcttatttcttgtcctttgctgtcgtgtgtgatgtcagccattgcatattcttcgaatttcttacgatctaccgactgttggttacggataatgtctgtcagtgaaaaaccttctccccacaattctttacggcgttccagccagatttccttcaacagttcgtcgcctgttgctgtaacggcaggcgattcgaatccgtttttcatacggacatcacgcaattccttcagcaaggcctgagcttcgcttgtcttgcctgccagatgtgcagcagcttctgccttaatcaggtacatttctgccacacgcatcataatgacatctcccagcatgttgttgatatcggcaaacaggaacttataattcaacatggcacattcaccgtaacctgcattcaacccccatttgaacagatctctacggtagtcgttcttatcgaacagctccttaaagtgagggtctgcattgaagttggtatagccactacccggagttgaggtatctttataatggaagttgtaggcgggaaggttgtcatcctgtgtacaagaatagccccacatccattctttattcagggcattgttgaaacctgacttgtattctgcttcactcatcaggtagttgttcttcaacttcatagcctcgtctgcatacttgtaagcatcttcccacttgcgggcatataagctggcgcgtgctcttagaccggttacgacgatatggtcgatcttgtattgatccgttgcatttgagcctcggttatagtctgccggaatcaggtcatatccccatttcaaatcgttcaaagcttgttcgtatacctccgatacacttgcagcaggctttccggtggttgctgtattgtagtcagttggttctgtatagataggcacgcatactgcattcggctccttatcgatggcaaaagaatagtggcttgccaacagcatatacaggaaaccacgggtagcataagcctgtcctttgatgcggttcttttcttcctgatctcccgaaataccgtcgatgttcttgagaacggcattgcagttattgattggatcgtacaccatgtcccacattacgtcgtttatttctccgcgtccgtagccgttggtcagtttatagctggaagaataaccgtaactggtagttcttactacatcggagccggcaaaatcatcgtttatcatgatggctccgtagccgatggaagcataggtagaaccggaattaaagatatagttccaggctcctctgattacacggtcggcattttccagatttttgaatacagcatttgcttcaagtgaagttgtaggagctgtatcgaggtcgcaggctgtaacggtgcaggcagccagtgcggtaaggcatatatttttataattgaatttcatcttttgtcaaattttttaaagagttacattaataccgaatgagaaagtcttcatagccggatagcgatatgatacgacaccgctgataggctgttcaggatcaagaccttgctggtgactgaatgtcaacaggttttcgccttgaacaaagatgttggcatctttcagtgtggcaaagtgtatccatctctgaggtaaggtatagcttaatgtaaccgttttcaaacgcaagaatgaacggtttaccagccagcggcttgagctgctggtgaagtaactagtctggtcgtacgacagacgtggaatgtctgtgtatcgattttccggagtccagcgattcagcatgtcttcgctcatcgagctaccgtttccacccttaacgctcatcatctgtatcttatcgttgttgtacagcttaccgccgatagcataagagaacaacatggacagcgacaggttcttccaggtaaggtctgactggaaaccaccgctcagtgtaggaagtgagctgcctacttttaccttatcgttcggtgtcaggcttgaataatcttctgtaatctggcggctgccatccttggcggtgtaataccactgcggcttaccgttctccggatttacacccgcccattcatacaaccagaagtcgtacagcgaaccacctttcacccatttcttagaactctgccacataacttcggtcggcagttcaacaattttgtttttataagtagtggcatttacactcagcttccaagtccagtcttttgtcatgactggagtaccgctgatggtaaattcccaaccgtagtttttcagcttaccgatattggcatcgatgcttgcgaatcctcccgacggcaccagatcgcgggcaaacagcaaatctttagaagaacgctggaagaattcaatcgtaccgttcagtcggttactccagaatccgaagtccagacctacgttcaagttcaggtttgtttcccagctcaaatccggtgtttccagacgtgaagcatgcagggtagattcacccagtgaactaccgatagtataaagtgccttataagcgtagtaacctacattgtcattaccttgtgcaccatagctggcacggagtgtcaggttgctcagccagttattgcttgctgcttccagaaacttttcacgtgaaatcttccatgaaccaccgaaagaccagaaggtaccccatcggttatccggatggaagcgtgaagaaccgtcggtacgtaccgaagccgatacgaaatatctgctctgatatgaatactcagcgcttccgaagaaactcaacagtttgtactggtcgctgtttccgccaaagctgctcaatgtagaagctacatccggttcataatagccatcggtgatgacaccggttcttgaaccggagaaattggaagtattgtattcgtaatactcctgaccagccatcaatcggacatcgtgatcctccttgaacgtatgattccagttgatgacgttgttgtacgtcataccagtagtacggtcgttacccttttctacactacctgtcagcggcttcttgccgtaagtcgggttactgtagttatgggtaaacatactgtcgtagtcgatgttcagcgacattttgtagctcaaaccttcgaacggagtaatctgtaaataaccacggatagaagctgcatcgcgtttgtactcctttttatcgtacaacatagactgtgcgaagttgtagccgttgtacgaacctttacggtaggttccataatcgtaaacacggttcccgttttcatccagaatatattcaccggttgtcatatcgcgttcgtaaaccggatagaaagaaggaatatcgcgtgcagccagtacgatattgccgatggcagtatcattctgtttcggatagttctggatagaatgggttgcagatacattcagccctacctgcaaccatttacgtaagtcggtagtaatgttcgaacgcaggttgtaacgtttgaatccggaacagatataagcaccctgatcgtccaggtagcctagtgaaaaataatatttagtcttttcactacctcctgatacgcttgcgtttaaatcagcgtagtgcgcattctgcgacaaggcatcttcccagctgtcgttccataacggagtggcaccggctacaatttttccatccgttcctaccggttgtggataacttgtaccataaggattgatacccagaccgcctgtttgggtggtagctacgatagctgaggcgttctgagcagcagtaacaggatctgaaccgttgtcgatgtagctgttacgcaatgcttcccattgcaacatgaaataatcatctgtgctcaactggtcgtaatcgcgtacggcacggcttgagaaaccgtacttagccgataactggatagttggggctgaaccattctgtccttgtttggtcgtaatcatgatgacaccgtttgctgcacgagaaccataaagagaagcagcagcggcatctttcaaaactgtaacagaagcaatatcttgtgaagaaatagatgaaagtttgccatcgtaaggcacaccgtcgactacatacaatggggtttgtgaagcatttgcagaacctaccccacggatatagatatcggcatcttcacccggttgtccactggtagagaacgactgcaaaccggctacagttccctgcaaggcttttgatacacttgaaacctgtgatgcagctacaattttcttgtcgataacactggcagaaccagtgaaagtagatttttttgcggtaccataaggtacggcaataacaacttcatcaatggctacggaagattctttcaaatcgacgttgattactttctgacctttgacgggcatttctacagtttcatatccgatgaatgaaaataccaatgtactttttgcatctacttgtagtgaatagctaccgtctatggaggtaatggtaccattcgttcctcctttgactgctactgttacccctggcatctcttctccgttggcagtaactttcccgttcacagtgatattctgtgcataggttgccacgcagattagcatactgcacagcagtgataagaacttactcataaatctctcttaataaaatggttaaatataaatttcaatctttaaagtgctaagtgattgcattctcttccactgaagaggcacatattccctttcttattattcagttgttttgtgttttttatcttaaaatctcaatcgggcggcaaaagtataaaatattttgtatcgaatgaaataaaaaacgatttattttgtatgtttatactattcatgtatataatcactatatatatacattattactttcggttgtaaagcggcaaagcttcggattctatgaccttgttcgtctgtttgccggaaaatcgttaactttgcagccgaaaccaacaagaaaagatgaattactcaataaaggacttcgaaattatggcaccggtcggctcccgagagtcgctggctgcggctattcatgcaggagcagattctatctatttcggcattgaaagcctgaatatgcgtgctcgttcagcaaacacgtttacggtagacgacctgcgtgagattgccagagtatgcgatgaaaacggtgtgaaaagttatctgactgtaaatacaattatttacgatgaagatatcgccttgatgcggaagattgtggatgcagcaaaggaagcgggcatcagtgcagtaattgctgccgatgtagcagtcatggcttattgtaaccagataggacaggaggtgcatttgtctacccagttgaatatcagcaatgcggaagccttgaagttttatgcacagtttgccgatgtagtggtactggcacgtgagctgaacttgaagcaggtgcgtaagatttacgatgcaattcatgaacagcatattacgggaccgatggggcagccggtacgtatcgagatgttctgtcatggggctttgtgtatggctgtgtcgggcaagtgttatctgagcttgaacgaactgaatgcttcggcaaaccgtggggcttgcatgcaggtctgccgtcgtgcctatatcgtgaaggataaggaaagtgatatcgaactggaagtcgataaccagtatatcatgtcgccaaaggatctgaaaacgattcattttatggacgagatgatagaagccggtgttcgggtattcaagattgaaggacgtgcacgtggacctgagtatgtgcgtaccgtggtggaatgttataaagaagctattcgttcgtatctggaaggtacctttacggaagaaaagaaagccgactgggatactcgccttaagaccgtatttaaccgtggcttctggaatggttattatctgggacagcgtttgggagaatggagcaagaactatggttcggaggctacagagcgtaaggtatatgccggacgtggtatcaagtatttctcgaacatcggtgttgctgaattcctgattgaagcttccgaaatcaaggtgggcgacaaactcctgattacaggacctacaacgggagcaatgtatgttacactggacgaagcacgtgtcgacctgaaaccggtagatgtagtaaagaaaggtgtgcatgtttcgtttaaggtccccgaccgtattcgccccagcgacaagctttaccgtattgttcctgccgatgaactgaaaaagaaataatctttatcgcttatataagatatacccctttgacgtttattctctcttggtgcaaaagcaccatttgggggaatggacgtgagaggggtattctgtttgttggaatttgctgatgattcaaaaaagcatggcgttgtctggtaaaaaacgtcgagatatttttttattttttgtacagaagaatcgaaaatttgtacaaaaaaaagatgaactcatgccgataccttgagaaaagccggtatcgtgtgtctgagttcatctgtatctttgctggaaagtaagagcttgtcagtgtcagagttctccctttcggatagcttccatgatattggctggtggacgctgagccagcaattccttcttcatgtagtccatgtaaggcgctacatggtcgaaatactgataatatcctttacacagataatttagtccaggttctccggaagctgtcttgcagaaacggttcttcggacattcaccgttgcaggcaaacagatactggcattccttgcattgtgtaggtaacttctccgatttatcgcgaccaaattgcaattgcttctcgctgtacatcatctctaccagcgatttggaatagatattgcccaatttatattgtggaaatacaaagtggtcgcaggcgtatacgtcgccattaaattctatgactcccgcatgtccgcagttttttgccagtgtacagatgccgggttgttcgcctacccagttggcgagggttgaatcgaacagctggataaaatattcgcctacgtcattccgtacccattcatcgaatatggtacagaggaagttgccccattgttcgggagttactgaaaaatcggtaaccgtttcttctgctccttcttctaccgaggcaagataccgtccgtcggcatgtcggaaaatacgttctacaatcggggtaaactggatataccggcaacctatctccttaaagaaatgataaaaatcgagcggatagtcggtattgaaatcgtttaccactgccaatgcattccactctacttgatgtttattcagtaagttgatgccttgcatgaccttgacaaacgaaggctttccctgtttgtttttccgatattcgtcgtgaaactcctgtggcccgtcgatggaaactcctaccagccagtggttatcgtgaaagaaacgacaccagtcgtcggtcagcaatgtaccatttgtctggatgcaattgtcgatgattctgcctctgccatattttttttgtaaggctatcgcctttttgtaaaaatcaagcgggcgcattaaggtttctcctccatgccatgtaaaaagtacttgtggcatggtctgactctcaatatattccttgatgaacttttccaacagctcgtcgctcataatctgcttggaagtgtcttgataaagcttggctttctccagataataacagtaatggcaagccaggttacagagtgatccggcgggctttgccatgatatacatcggacgggcgaacggggcgaatgtagtcattgtataataatggtgttaatataatattagttgggtgaaaatgtaaattattctagtgtgatgcttcttacgtgtacttgctgatgcaggaaaatggaagcggcttcctgaaacttttcgaccgattcggttgtaagaaattcacaactgctgcctgccgtacaacgggttcgcatgtctgtatgacgggaaagatagtccttcaaacttcgtgctacgtattctccttgggctaccagacggatatgtgacggagtgaactgccgtatcttatccatgagcaaaggatagtgtgtacaacctaatataatggtgtctatctcgggatcttgttccaacaactgatcaatatacttgtgtacaaaataatccgctcccggagaattaaactcattgttttctaccaaaggaacccatagtggacaagctactcctgtaatctgaacatcgggataaagcttacgtacttccagcgggtaagactgagatttgactgtccctgcggtagcaagtagtccgacgtggcgtgaaaccgtcagttcccctatacattcggcagtagggcgtatcactcccagtactcggcgactcgggtctatgtgcggaaggtcgttttgctgaatgcttcttaaggcttttgctgatgcagtattgcaggcaagtatcaccagcgggcatcccaattcaaacagtttccgtacagcttgcagtgtaaattcgtagacaacttcgaacgaacgtgttccgtatggggtacgagcgttatctcccagataaatgtaatcgtattggggaagtaattcacgaatcttgtcgaggattgtcagtcctccatatccggaatcgaaaactccgataggtcctgtagtagaaagcatggggaaatttgattaagaggtgaaaaaagaattgtcattgaccgcatccgaagagaatgaagtcaatgacaactttatttttgttacgttgaaaacacgtttttactgagcaggagttgctgccggtgctgtagccggaacagctgtcaagctgatacccaacttggtcttgatgtcgtttgttacatctttcgacattgtttcgtttacataaggaatatccgtacggttcaggtcgaatacataagtgtaaccacctgtagttccgatagattttacagcatcttccagtttcttgtagataggttccatcatgtcagcataagctttctgcaactgctgctgtgcatcctgctggaactgcatacctttgtcagaaagttcctgaagttctttctggcgacgttcttgaatattttgtggaagagttttctgttcttgctgatattcggcgaatttcttgttgaactcatcagatgcacgtttgatttcgtcttcatactgtttctgcaatgcctgaatgtcagtttgagcttttgcatattccggcataaccgggatgatgtccatagacttgaagtgtgcgaacttctgtgcgaatacactcatcggagcgatgagtaaaagtaataaagcaatttttttcaacataatcttatttgtttctattgtgttattaattcttgtcttttgattttatgtgctgtctgtgttagactttgcaaaagtataaaattaatttgaatatcctaatttagagagaacttcgttactgatatcgatacgtggagaggcaaaaatcatgctttgtgccgatgcacggtctataacagcatcataatttttctgtgttgcaatgtcttttatcgcattgtatatggcatcttgaatcgggccgatcagttcctgacgcttcttcatgccttcaccttcaggaccgaaatatttttttcgtaagtcggctgcttctttttcctttgcgatgatagcgttttctcgttctgtcttttgagtagccgatagagtagaagcatttttttgatactcatcatatagcgtctttgcttcctgagcttttgtctctatttcactttgccattgttttgacagattctccatttgttggtttgcttgttcgtaggcaggtatctgctttaagatgtactccatgtctaccaaggcaaatcgttgcgcctgtgtggctatgctacacacgagcaaggctgctagaaagatgatttttttcataaagcaatgtttttaatataatgaagaatgataaatgaaaaactcattattcctgtcgactgttttggaatctatttttcatttctcattcttcagttcttcatttattggtcttttttgttagaattcttgtccgataataaagtggaactggcttccgctatactgggtagaaccgttgatcttgtcgaagccataagcccagtcgatacccatcataccaatcatcggcaggaagatacgtacacctacaccggcagaacgtttcaactggaacgggttgaacttattgacatctgtccatgcattacctgcttcaacaaagcccagcgcatagatactggttgagttctccagcatcagcggataacgtaattctgcacctaaacggatgtaagcgtaaccttcgctaccgtatggagtcagagatccgttttcgtaaccacgcaaggcgatagtttctgaagcgtagttataactatatcctgtcataccgtcaccacccacatagaatgtttcgaacggtgaacgcttgtatttgttgaagtgtcccagaataccaaactctgtacgagtcatgataaccggacatttctggatatccatcagggcggtataagtttttgctttgaatttccatttgtggtattcaatccacttatacatgctggctgcttcttcgtaattgtcttttccgtaagtagagtaatccttcttactgaacagtgagtaaggcggagtaatctgtaaagaagctgtaaactcagaaccgtaacgcgggaaaatcgggttatcggttgagttacgcgataatgtcaggttcaagcttaagctgttgcagttaccagtattcatatactgtccgttgttcagcataatgtacaagtagctccagtctttcaacataaatcgctggtaagacaattctgccatcaaggtaaagtagtcatccggccagcgaagacgtttaccccaacccagtgaaacaccaaacatcttgatggacttgtccgggtcgtagtacgattcatagttatcataataaccgccgtagtagtttccgtaaccactcaggtagttgtaatagttgttcatgtaagcagagttataatactggctgctgacgtcggtctgtacagaatagaaggctgataccgataaggagttcggacgcttaccaccgaaccatggatcaaggaatgagatactgtacgactgatagtatcgaccgttggtctgaccactgatggtcaatgtctggccatcaccttgtggcaggaagccacggaagttgtcattcttgcggaagaggttggcaaatgagaagttggtaaacttcaagctcaacttaccgatgatacctgtttgtccccaaccggcagagaactctacctggtcgtttgcctttgattccagtccccagttgatatcaactgttccgttttcgtagttaggctgcacatccggcttgatattttcagggttgaaatgtcccatttgcgcaatttcacgataagaacgttccaaagcctctttactgaacaaatcacccggacgagtacgaagctcacggcggacaacgttttcatacaaacggtcgttaccattgatacgtacgtgactgatacttgcctgtggaccttcgacgatacgcatttccaggtcaatggagtcaccgtcgatgtttacttctaccgggtcgaggtgatagaacacataacctcggttataatagttattaccgatagcatcctcatcgttactgatacggtcgttcaacagtttctggttgtatacatctcctcgcttcatgcgtaactgctcattcagcaagtcggaaggataaacggtattacctacccatgtaatgtctctcaggtaatacttgttaccttcatagattttcatgtatacgtctactgtcttttcatcgtatggagtaacactgtctacctcgatgatagcgtcacggtagcccagctcgttatatttatcaataattttctgcttatcttcttcgtatctttcattgataaatttctttgcgcggaacaagttgaccagcttgcctttttcgtttgtctttttcatgacacgcttcaacttcttgtctgtcaggacactgtttccgtcgattgtaattttatggacttttactttatcctttttatcaatattaacatctacatatacttgttctttgtttgcagggtcttcacgttctacaatattgacttccgcattcttaaatcctttttcatcaaagtgtcttttgatgatgatttttgctcggtctatcaagttcggagtaatctgactacctttagccattcccagtttagcctgcaaatcttcccgctcgcttttcttaactccattaaaacgaatatctgtgatacgcggacgcaacgttaagtggatgaacaaatagattttgttaccttctattttttcggctgtaattttaacatccgagaacaagccatggcgccaatagcgtttgatagcactggtaatatcatcacccggtacagtaattgtctgtcccactgcaagtcctgaaatacctatcaagacataatcttcgtagttatcaatatttgtaactttgatgtcggctatttcatactttttaggtgtaccattatataaaattaccggcttgtcattttcggtattggtattttcttgtgcatgtaccgttgagaaactgaacatgcaagccaaagttaataggatgaggtaaaaacagtatcgcatttcttatttcaatatttgttcacttgttttgccgaatcggcgttctcttctttgataatcacagattgctttacacagctcttcttctttgaaatcgggccagtatgtatcacaaaaataaagctcagaataagcacattgccatagcaagtagttactcaggcgtatttcgccgcccgtacgtatcagtaaatccggatctggcataaaattagtggccagatgctgatcgatggttcggtcggttatactgtttatgtttagtttaccgctgactgctttactggcaatctgtcggacagcattggttatttcccatttagaagaataacttaaagccaaaactaaacacatgcctgtattttgtgaagtacgctgtacacattgattcaaccggttctgaacatcggttggtaatttctcagtgtctccaattatacggaaactgatattgtttttcataaaagtttcttcctcgatggaatccatcagaagactcatcaaagctgcaacttcgtctgcgggacggctccagttttcggtagaaaatgtataaagtgtgagaaactttactcctaggcgtgctgcttcttctgcaatgacatgaactgtttccgcacctgcctgatgaccgaacgagcgggcttgcccccgttgtttggcccatcgaccgttaccatccatgatgatagcaatatgagcgggtattcgtgtcttgtccacttggtctttatatagcatagctttcagatttagatttattcccatttgggcagaaaaccaaagtggtttacacgtcctctgctcatgtatccattgttccaaataatccagatgaagttgttttgatctactatacatgagtaacttccttcacctttatttttgcctttgttgtataactcaacgaaagatgtaccttccgttgcaaaggtcatgttttcttgtacggcttcccatgtcagaccattatctgttgaacagaagaatgtgctaaatggtgatttataatcagtataatcttggctcgttatttcaccgccgaacacatataactttttgttgtagtagatgaatgaaggatcgacgatattagggcatctgaatgtatcagtctgctcataattataggaactccacatttcatcgtttgtcatgcgtgtagctacgaaacccgagcctttgacttttgtggaattatatcccagcaggatagaacgggttaggttgttattataagaaacgggaatatttgctgatatgattttttgtcctttgcttggaaactcagaaagattggactgttctgttgttcccgtcttactttgcacattgtatatataagattcattattggctgtacgagcatatagtgaattgtcaatgcttgttaaaagctgatctaaagcgactgatagattctgactttcatatccattgtcggtcagtttgtacaattcctgattgacaaggaaataaatgtttccctgacacaatgttgcagaataagtgtcagtctgttgtggtaacgcaatagcagtccatgtttttcccggatttccgtttgaaaccgttgtatattcagcaaccatctttccttcagaggtttgcccgaatacataaatacaattgtttatataaactgccttttgtttggttagtgtacctgaagtaaatgcgctacccatgagttccttgttccactgcaatgagtctggttcttgcgtgtgtacgttgactttcacatggtaagcctttcctaccactccgctataggccaataccttaaatgtcagaccttcggatggcgcaaacgaaaaattaatagaatcagtcgaagtccaaagtgtatctttggcttcggcaccttttgaggttattttcccatagagaatataattactgtcggctgtaatgttcgtaatgaccctcgatatatcagttcctacaggaagtgaatccttattctcgattgttctcatagcctgattgatcgtaaaaggataattcgccatcgaaatagtatctgtgtacgtagaatcttcacctttcgaatctttcccaactcgtttgacatgtaatgttccgagtgagaatgatgtgatactagtttcagaactataagtaacttcctcaacatcactattcaagcaagaagtcatagtagacattacagttaataaaccgaccgccaatatgggtaaaaactttattttcatttataaaatagtctttgattacaagttgcaaaagtagaaagttttttttcgaataagaacttttatatcaagttttatataaaattatggataagcgtaacttttttatctacgaatcaacgatttttttgcttatttctcataatgagttatcgtaacaccgtctcgtcgtaagaaatttttcttatatccggctggaataacaggcccttttacgccattttcaaggacttttgctgagtgctctgtataaatttcgtcccataacccttcgtcaatgaaggattgcaacagctgacttccaccttcaacaagtaatgcctgtaacttgttttcgtagagcttttgtagtatttgtggaagaatacttcggctaaaatccaatttaaagtaagtaacttgtgaggttgatgctttgtcttgtgctgtaaaaatccatgtaggtgcactcccgtcgaagagtttcagcgacgtaggaagagtgagctctttatctattaccagacggacaggattttttccgtaccagttgcgtgtcgttagtgacggattatccagtaatgcagttctacggcccactaagatagcatggtgttctgcacgctgtttgtgtacgtacattaatgtgattggcgttgagagtacgacaggctgaccttcttcacggtttatatcgataaatccgtcggcagattcagcccatttcagggtgatgtacggacgttgttgggtattgaatgttacaaaacgcttgattaactggcggcattctgcttcgagtactcctacctttacatcaatacctgcatcttttagtttttgaatgcctctgcccgaaacaagagagaaaggatcgacacatcctactactacacgggggataccctttcttatgatcaaatcggcgcaaggaggtgttttcccataatgagagcatggctccagactgacgtagatggttgattcctgaagcaggctctcgtcttttacggaacggatggcgttaacttcagcatgcccttctccgcaacgtgcatgatagccttcaccgatgatacggtcgttatgaacgattacagctcctaccatggggttaggagcagcattacacatcccattgcgtgccagttggatgcagcgccggatatatttttcgtcttttgtcatagtcggtttcttttttattcttacatttgtgcctatgcatcctatatatactcacatcaaacaatcgctcgcaggcatatattccgattcagaagcatcggcactggcaaaatggatattgacagaggtgttctgtctttccaccatcgacctctatgcgggcaaagatatgaatttttctacgaaagagtatgccaagctggaagatattctttcccgtctcaaacgatatgaacccttgcaatatatattgggaaagacgaccttttgcggcttgccttttgaagttgctcccggtgtactgatacctcgtcctgaaacggaggaactggtggactggattatctctgattatttagaaaaatcggaagtacggatacttgatatcggaacaggcagtgggtgcatcccaataacgttggccaggagtttaaaaaatagtaaagtaacgtcatgggatgtgtcgccagaggcattggcgatagccgaacgaaataaacggctgaacgaggttgaaataacattggcacaaattgatatattcgattctacgttaccagaaattcatgctgatgtcttggttagcaatccaccttatgtaacggaaaaggagcgtagcgatatggagcgtaatgtcctggattgggagccggaactggcattgtttgttccggacagtgaccctttgttgttttatagaagaatagcggaagtaggatgcgatatcttatcttcgggaggtatattatactacgaaataaatcgtgcgtatggtagcgaaacagttacattattggagcagatgggatataagtctgttgaactacggaaagatcagtttggtaacgaccgtatggtaaaagcactcagaccatgaaagaatatacggaaaatgaattgaaatataaagctgaggcgtattgttccgctacggaacattgccccttcgaggttatgacgaagcttagtcagtggggtgccgatgaagcaatgtcggaacgtatattgttgcacttgcaaaaagaacgctatgttgattctgctcgttactgccgtgcgtttgtgcgcgacaaatatcgttttgcccgttgggggagaatgaagatcgttcaggcgttgcggatgaaacatctttcttctgaagatattgaggctggtatggcagaaatagatgaagaagaatacgaaaaaggattgcgcgatttattgcgtcaaaagagcaagtccgtttctgggagaaacgaatatgagcgtaatactaaacttattcgttttgctgttggcagagggtttacgatgaatgaagtattacgttatgtaaaacaggccgatcccgatgaacttatggactgatatagtggaatttttctttcctcgtttatgtctgtcgtgtggaagaaaattattactggcagaagaaggactttgcatatcgtgtcttgccggattgccgtataccaaattaggtaacactcccggcaatgaaatggagaagtgtttttgggggcgttttcctgtcgttcgtgcctcgtcacttttttattatgcaaagggaggaaatgtcgctctgatcctgtatgccatgaaatatcacgggcggaaaaaactttgccgtaatatgggaaggttaatggctggcgaattgctggcttccggtttttttgaaggaatagattatttgcttcccgttcccttataccgctcccgtttacgtcagagaggatataatcaaagcgaacttcttgcccggggaatatcggaggtgacgggtatttccttgtgtacagatgccattgttcgttcacggaacaatgctacacaaacgcataaaagtgggtatgcacgctggaaaaatgtagaaggtttgtttcagccgactgtaaatgcgcccaaattagaaggaaagcacattttgttggtagatgatgtcttgacaaccggtgctacgctgatagcttgcgccgatgccttgtcggaactaaaaagtataagaataagtgtgcttactttagcatgggcacggtaagcaatatggtttctttaactaaaaaatatacacatatatttcatattcacgtaggatttacataattttgcaccaacgtttatcagatatatttaaggtatgaaagctttggaaagattatttgcagaaaaattactgaaagtaaaagccgtaaaaattcagccggctaacccgtttacttgggcttctggttggaaatcgcctatttattgtgacaatcgtaagactttgtcttatccggcattgcgtaatttcgtaaagttggaattgtgtcgcgtaattcttgaaaaatttggtgaggtagatgctattgccggtgtagcaacaggagctattgctcaaggtgctttggtggctgaagaattgaacctcccgtttgtatatgtacgttcaagcccaaaagatcatggcttggaaaacctgatagaaggtgaacttcgtccgggtatgaaggtagtagtggtagaggacctgatctctacaggtggaagcagcttgaaagctgttgatgctatccgccgcaatggatgtgaggttatcggtatggtagcttctttcacttatggattcgatgtttctgtagaagccttcaaggaagcaaaagtagaactggttacattgaccaactacaatgcagttctggatgcagccttgaaaactgactacattgacgaacaagatatccctgttcttcaggcttggagaaaagatcctgcacactggacaggaaaataattcaacattaaatattattgggcacggattacacggagtgcacggtttctcagcaaatcgtgttatccatgcaatccgtgttcttttttatgtaaaaacagcattatggtacaatttgaaagcactgtaaagcatgttccttatagccaggaacgagtatataataagttgtccgacctgagcaatctggaatcggtacgtgaacgtctggatatgatgaaggaaaagttggcaggcaaggtagaagatttgtctttcgaccgcgattcactgaccctaaaagtacaaggtatcaatctgaccttgcgtatcattgaacgtgaaccgatgaaatgtgtcaagttcgaaggagacaaaacccctgttcctctgaacttgtggatacagatacttccggttaccgaagaggaggcaaagataaaagttactatccgcgccgaagtaaacatgtttatgaaagcgatggtatcgaaaccattgcaggaaggagtggagaagctggtagatatgctggctatgataccgtattaatttaaatcaatcaagaaactatggctcagaaactttgggaaaaaagtgttcaggtaaacgaggaaatagatcgctttaccgttggaagagatcgtgaactggatctttatctggcaaaacacgatgtgttgggttcgatggctcatatcacgatgctggaaagtatcgggctgttaactgccgatgaattacaagtcttactgaaagagttgaaaaatatttatgcttcggccgaacgtggagagtttgtcatcgaggatggtatagaagatgttcattctcaggtagaactgatgttgacgcgtaaattgggagatatcggtaagaagatacatagcggacgctcacgtaacgatcaggtactggtcgatttgaagctttttacccgtgaacagatcaagcagatagctgaagctgtacaagacttgttccatgtgttgatttctcaaagtaataaatacaaggatgtcctgatgccgggatatacccacctgcagattgctatgccttcttccttcggtttgtggttcggggcatacgccgagagtctggtcgacgatatgatgttccttcaggctgcttataagatgtgcaaccgtaatccccttggttcagctgccggctatggctcttcattccctctcgatagagaaatgacgactcgtttgctgggttttgattcaatgaattacaatgtggtttatgctcagatgggacgtggcaaaatggaacgtaacgtggcttttgccttggcttccattgccggaacggtttcgaagatggcttttgatgcctgtatgttcagttgtcagaatttcggctttgtaaaattgccggacgaatgtacgacaggttccagcatcatgccgcataagaagaacccggatgtattcgaactgactcgtgcaaaatgcaacaaactgcaatcgcttccgcagcagattatgatgattatgaacaatctgccgtctgggtatttccgcgatctgcaaattattaaagaagtcttcctacctgcattcgctgaattgaaagactgcttgcgaatgtcggcttatatcatggataagatcaaagtaaacgaacatatactggacgatgataaatatatctacatgtttagtgtagaggaggtaaatcgtctggcagcagcaggcatgccgttccgcgatgcttataaaaaggtaggactggatattgaggccggaaaatttacacacagcaaagaagtacatcatacacatgccggaagcatcggcaatttgtgtaacgataagattacagctttgatggaagaagtttcaaaaggctttaattttacggcagtagaggaagcagaaaagaagcttttaggccgataaacagctttttttgagaagaaaacgggagaaatgtttggagcttattgtaaaactccctacatttgcacccgtaaatgcggaaatagctcagttggtagagcataaccttgccaaggttagggtcgcgagttcgagtctcgttttccgctcttttaaggctgctcgaatggtggaatcggtagacacgagggacttaaaatcccttggccattgcggctgtgcgggttcaagtcccgcttcgagtacgaatcaatagttatatcccttgtaagttaattgcttatgagggatttctttttattggcataaacatagcatacaagggctcaacgtaaaaacctgaggaattcgttgattaggcataaattttagccagcctgaacaaaagaaggccttatcttttactcctctgaacagtgaacggaactctttatttttacattgaaggattctggcaagtcttgtcaatgtggtattcttatgcttccactggtgatatatcagtccgaatctcattgaaagatagtaagctttctttatatcgggatattctctgaagaggatttcggcacgctgtgattcgatccataaggactctttctgaatcattgacgaaaaagggttatctcttacgagatttactttgtgattaatcattggttattcatgatcttatcgccaagaacaaaaattttttgtacaaattttaaaaaaacgtctcgagaagttgattaaaagatgccgacgttttccttaaaaccaaaaattttttagatgtttttgcccttcacgctcttcacaattacttataatcagcagttcaaataagttttttcaaaaattagatggatgtaagagagcaatagtgtatgtatgtgaagggcgtgaagggtaaaattagaagatttcttttcctttagacaccaattcggcaacatttttagcattcagtttctccatcaatcgttttcggtatgtctggatcgtattggtacttaaacataataaggctgctatttgagaggtactgagaccttccgccaggtgggaaagtacttccttttctcgtttggaaagttccggtattttatgaccttcggtggttgactttcgtttgttgagggttgcgaagccctcactaaagtacttattccccattctgatgcttgtaatggctgtacttaactcactggtgtcagtgtgtttggaaacagccccggaaatgtttaattctgatagtcgggcaatgacccacggctcttcatgcatggtataaatcagaattttgcatgacggtagttcgtcttgtaagatatggatgaactggaacccgtttgtgtcaggaaattccagatccgtaatgcacatgtcaaactgttcggaagcgattacggacaataggtctttcaagcaagtaatacttttacatgttatattcttttgtcgagaagcgatggctgcaataccttctgctacgatgggatggtcatcgatgatgagtaatttgtatatgtcgggattcatggtcatgataattttaattgaagtgtaaatatattgtttttttcagacgattctcgggtgataataccgttaatgctcttggcgcggtcgtttacagtacgtaatccaattcctctgtctttcgtttcgtgaggtatagatattgtgctgtcgtctattatttgtaatatatatacttgttgatgttctgtatacagcttgatggatatatgatgggcatctgtatgtcttatgatattcatggtaatttcttgcacgatgcgatatagttcatgagctgtttcgtttggtaacaagcgagaacctttatcaggaatgcctgaataagttacttttatccccgtattgttgcttaacttatcagcgtattgatatagtatctcgtctaaggtcagatgtaaaaattcaggtggcatcagttcgtgtgagatattgcgtacattatttctcaattgtttgataagagcacttaactcttgagtataatgggggtagtagagttttctaccttcatttgtaatcctaataagtcgttagctataccgtcgtgtaattctttggcaaaatatttacattcagcttccagcccctcaatatattttcgggcagaattcaattcattttcctgttgaagttgtcggatttttttctctacaattttttttcttgtaacgtaagatgaacaaggctattaagataataattagtagacctacagtacatattgcagctttaagtaaggcggtttggtgcgtaagcttttcttgttgcaaccgatttatttgtagctctttttcctgcatttggattttaacattcagttcagccatcttttgagtcaggttttgctgtgcaagcgtatccgtccacatacgtgcactatccatgtatgtgtaagctaattgttgttctcctatcgcgttataacagttagctatttgtttcaggattgtttcgggctcactacctgtatcctttttccgcagccacaaaagatcttgtagcgctttgtcgtaattttttcggtgtatttctgtggaggctcgtatttggataaagcctatggcaggaatgctgttcacaggagtttgttttagtaattcgttccctaattgaagatagtagtctacggagtctggttgtccttttctttcaaaaattcttaataaagaaggcatgcatcgcattttccatcttgttgagttaccgtctgcatggcaggcgatatcccaagctttgcggatagaatatgttgcctcatccagtttatttacttcaactttgataccagaccggagttgccaggtactgaatgttacaaatggatcgtttgtttcggtagcgtgtcttgcggccaagtcggcatattgttcagcttcggtagtcatccggatgttaaaataaaatatggatatattattgtaaatatgggtaatccaactttcgtctttatgttttaaggcggcatcaagtgctttgttataataatagatcgttgagtcattcatatgccacctgcgataaaggatagccaggtcattgtatatactaatatgtttttccagatcttttatttgggacagatagggaaggacattctttttcatggtaaaggcttgttcctcttctcctaaatatactaataaggtagcctgttcgttcagtaaaataggataaacgggagactgctttactttgggtacggcaaaagcactgtcgaaaacctcttgtgctgccttaaaactaccttctatcatgagattagtagctcgactatataaatgcattagtaatgaatcagtcgggatatcagttgaataaagcggacaagtgccaagtagcagtagtattactaatagatagcggtagattatcttcattctgcttgtcgtatttgtttaggtggcaaatatatatatttttattcgtaataaatttttgtctcggcagaaatgtgttaggtaacatacgtgatattccgaaaaatcacttttttaggtgacaaattgtaatagaatttatttattaatttgcaaaagatgattaagatggagtatcttgcttataagtaaggataaaagccatagatgactctgaaagagaaatgatcattatctatgaatagatcatagcttgcagattgtcttgtggttagttttaagttagaatctttttgaagttggatatgattgaagatatggggactccgagagactctttaaagtccttttttatttagtggttgtaagaaaaatcccttcactttagttttcgttaagtaaacgaggctgagtgaagggattatcttttttacatgaagtagatagaagtttaaaacgatggaagggtaaccttgaacagttcactgggttgatgctctcgctggatgatacctagcatcgtttttacaattgtaggattttgtgccgctacatcatggtcttcatgaatatcttctttcaggttatagagtgagggaactcctttcttgataaggagcttccagtcgcccatgcgtacggccatctggtcggtttcatgaaactcccagtataggaattcatgttcttgctgttttttatcgtttccaagaagtgttggggcaaatgaaattccgtcgaattcatctttatttttcccgataaacttcttgtcgccaatcaattcgcagaaggtggggagaatatcgtagaaagtaagctggtgatcgttggttgttccgcttgcaatatgtccgggccagcgtacgataaatggaatacggattcctccttcatagcattgacgtttgagccctctcagtttgccgtcgcgtccgaagaaagaaggatcggctccaccttcttcgtgagggccgttgtcactgctaaagaaaatgatggtattttcatccagccctttttctttaagctttgctagtatctcccctacataactatccagacgtgtgatcataccggcaaaatgtgcatgcgtgtggtccgatggattatatcgtgatccttcatctccgccccatgtcttgtcggtgaagaatttctttttatagccgttgaagatggaatcgtgaggctgagctagttcggcatggggaagagtgtatgtaaagataccacagaacggttgatctcctgtctgtgtatccagccatttcagcgcttcttgatggataaggtctgccgaatattgcggacgcttgaaatagtcgtcgccgaacatcggatacttgatattttcttctagtacgattcgtttcacttccttatcacctttcgagcggctataacggttcaggaaattgggatagtataggtgtgcctggaactgacaaatgtatccatagaattcgtctacgcctcgcttgtcgggagtagaccaggagccttcgtaacctcctgcccatttgccgaacattccggttgtatatccgtgttttttcatgacttcaggtaggatgacatgagtagaatcatacggttcctgaccgacaacagcgtaatctttgttttctccgtaggttacgacagcggactgtggccagtattctttgttgcctcgtacgtgggtatgtccgctgtgctgcccagtcattagagttgcacgtgatggagcacttaccggacttcctgcataggcttgtgtgaagcgcattccttctgccgccatctggtcaatattaggagtgtttatgtatttttgaccatagcaacctaagtcgccatatcccatgtcatcgcatagtataaagatgatattgggagttttatgctgtgcaaaagctcccgatgtgatcattaaagctgataaaatcagaccttcttttttcataatattatttatattcttagggtttatttgtttctgtccggtaaaactccggatagatagtataatctgttcgcgcgtgtgccgaagcgtatagtttacaaatttaggaaaatattattgtaatttactgctttactttgagatatattatctggttatagattatgtaggtaaaaatacaaaacaaaaagccaggccggctatgaaccagactggctttttgctgatatttcttttgtatgggaagatgaaaaatctttctatttttatttataatataatgttctgctgctttccttccatccaggttttaatattgtcgaagacgatatcggcacgggcctccatcgattcggctgaagcgaatgcaacatgcggagtcacaattgtattcttactgtgcagtaacgggtgattggtatcgaaaggcggttcattttcgaatacatcgatgccggccccacgcaggcggtcttcgttcagtgcttgggctagggcttcggagtcgaccactcctcctcgagaagtattgatgaggtaggctccttgtttcatttgtctgatacggtctgcattgatcagatgatgagtttcgggagtgagcgggcagtgaagggatacgatatccgattgctcaagtaactcatctaaagtgacgaagtgaatgaacgaaggttcattaccggttacgtgacgtttgttgcctagaattgtacatccgaatgcatggcatagttcagctgtgcgtgttccgatagctcctgcacctacgatgccgacagtcttacctctcagttcacatcctaccagaccgtctttggtctttccttcccggcagcgctcagatacctgaggtacgtttcggagtagagaaatcatcatacaaagggccagttcggctaccgactgggtagaatatcctgcggcattgcttacctgaattcctttagcacgggcagcttcgagggcgacatggtctactcccgtaaaggctacatcgatatattttagttttgaacagctgttgataacttctgcgctgagcggcatattggctattatgaggatatcggcatctttggcctcctctatttgaacctccggattggtatttttaggatatgccttaaactcatgtccggcttctgttagcggagctgtgtggcgttgtaaggaagcttcgctgattcccagtgattctaataatacgattttcattattttattgttttgctgtagatgaatttcagaatatgtataacaaagctatcagaaccattttattcttcggaaaatgacaaatgccatagccgacaaaaagattgacgagaatacgataatggagaaggcatgcggaagctcttctatgtgtatgtcgacattcattccgtaaaaactggctatcagggtcggcaccatcaggataatggacagacttgtcatacgcttcatgatagtattcacattgtttgaaatgatggaggcgaaggcatccatggttccggtcaggatatcactgtagatattgaccatgttgtgtgcttgtttcagttcaatcaatacatcgtctgttagttccggattctgatagtctttttcactgaaaatattttgtagtttaccaatcatgacttcattgccacgaatggaggtgttgaagtataccagtgttttctgtaagttcatcaggcgaagcaaatcctcgttctttatgcttctttccagttctttttcggccgtactcacttcgttgttgatttgcttcagatatttcagaaaccatactgccgacgagtagatgatgcgtaaaatcaattcgtgcttattgggcacattgatgcccttacgacaagtgtgctgaatgaaatcgggtatcatttcggtagaaaaatagcagatagatacgatgatctcattgttggttatgataccgatgggtacagttgtatatggaactttctgatgtggtgtctggatcgggatacgcaggatggtgagtagccagtttccttccgtatccgtacgaggacgttcgtcggtatcggctatatcatttaaaaatgaggcaggaactttcagttcttctttcaggaatctgaaatcatcgtcagtagggcattctacatttacccagcagttgggttgccagttcggaatttccataaaaccggctccgctgtaaagatactttctcattgcattgctcctttcttgttttgtgtccgccggcagtaagcaaggcaatgaaagctgattcaagccccggtttactcccggaggagaaagttaatactacatgtacacgttcgcgagtttgaatcgtccataaattaatttcttatttcgggttacaaaaaaaagctcgcctttcgacgaactttcttgctcttcaggttggacttgaaccaacgaccctctgattaacagtcagatgctctaaccgactgagctactgaagaagattaaatatatttaaaaagaatggctcttcaggttggacttgaaccaacgaccctctgattaacagtcagatgctctaaccgactgagctactgaagaatcattttgcaatctgagtcttttgctcttcaggttggacttgaaccaacgaccctctgattaacagtcagatgctctaaccgactgagctactgaagaaggtttttctcaattgcgacgcaaaggtagtaggatattttgaaatatgcaatatctttgcaaaaaaaatatagataaatggataaaattgttggaattggcaacgctttggtggatgtattggttctgatggatgatgacaaaatgctggaggacctgcatttaccgaaaggaagcatgcaattgatagataaaaaaacattatttgaaatacgagaaagaacggttgggcagaagttgcatcgggcaaccggaggggctgctgccaatacgatatgtgcacttgcagaattggaagctcagacaggattcatcggaaaagtggggagagatgagtttggtagattcttcgagcagacattaaagaagcgaggcgtagacacttccttgttgaagtgtgactgtccttcgggagttgcgtctgctttcgtttcgtcttgtggagagcgtacctttgctacctacttgggagcttcggctaccttgtgtgccgacgatttagcacgctctatgtttgaaggttactcctacttatatatagaaggatatcttttacaagaccacgatttgattgtccgggctatgcggttggcaaaagaaatgggattgcaagtttgtctggatatggcaagtttcaatgtcgttgaggctgaacgagacttttttgatatgctgatcacaaagtatgtcgatattgttttcgccaatgaaagcgaagcacgggcttataccggaaaagatccgcaggaagctttacaggagattgcttcaaagtgtagtatcgttattattaagaccggtaaagatggctcgctgataaagaaaggaactgaagaaatacaagcaaaaccgctgccggtaaagaaagttgtcgataccaccggagctggtgatttctatgcggccggttttctttacggtcttacgtgtggttattcgctcgagaagtgtgctcagattggtactattttggctggttctgtcattcagactgtaggaactgctctgacaaagaagaaatggaacgaaataaagttaaatattgaagctgttctgcaagcctgaacggaataatgtgtttatttgtagttaaaatcattgattatgaatacgaagaaaacgttgataggagtgtttgttgttgtgctgggactgggattatctagttttaaggacgacgatcgtaattttcagatagcaaaaaatctggatatctttaattctattttcaaggagctcgatttgttttatgtcgatacgatcaatcctgagaaaatgattcagaacggagtaaacggcatgttggcactgaccgatccgtatacggagtattatcctgaagaaggtgtcagtagcttgaaggaaatgattaccggaaaatacggaggtataggggctgctatccgatattataagaagaaagatcgtatagccattgtggagcctacggaaggtatgccagctgctgaggctggtgtgaaggcgggagatattattctttcggttggaggaaaagatatggtacgtggcgatatgaagcctcaggacttctcgtcgaaagttagcgaagcattgcgtggagaaccggggacatcctttgttctgaaagtgcttcgtccgctgaagaacgatagcacggtgatggaatttaagattactcgtaagaacattcgtaataatccggtcccatattacggtatgctgaaagatagtatcggttatctgtcgttgacgggctttacggataattgtgcaaaggatgtgaagaaagcatttatcgaattgaaacagcagggagctaaagcgctggtgattgatttgcgtgacaacggaggtggttcgttgcaggaagcagtagatatcatcaatttttttgtcccgaaagggaaggaaatcgttgtgaccaaaggaaagattcgtcaggctgcaggttcgttcaagacgcagaatgaaccgattgatacagaaatgccgctggctgtactggtgaatggcaatacggcttcggcttccgaaattttgagtggttcgatgcaggatatggatcgtgcagtaattatcggtacgcgtacgtatggaaagggactggtacagacaactcgtccattgccttataatggtacattgaaagttacaacatctaagtattatattccgagtgggcgttgtattcaggctattgactatgccaaaaagaatgctgacggctcggttgcacgtatccctgatagtttgacaactgtattccatacggctgccggacgtgaggtacgcgatggtggaggtattcgtccggatattgaagtgaagggagataagttcccaaatatcttgttttatttggtaaacgacgatttgatttttgattatgtaacacaatattgtctaacgcatccgacaattacttcggtagattcgatacaaattaccgatgccgattacgctgagtttaagaaacaagtcaaggctgccaattttacctacgatcgccagagcgaaaaattgctgaaaacattgaaagaggttgcagaatttgaaggatatatggatggtgcagccgatgagttcaaggcgttggagcagaaactgaatcataatctggaccgtgatctggattattttaccaaacctattaaagagcaaatagctgaggagattgccacccgttacttctatcagcgcggtgctgtcatgcaacgcctgaaagatgatgaggatttggataaggctattgaagtgctgacttccccggaaaaatataaagagatattgtcggctcctgtgaaagaagcagacaagaaataaaccattggtcggaaggctttaacaaaccggcaagaatacatttctcctactagtaagaagatatgtattcttgccggtttttttatgctcttttcacgtatacagaaaaaggattgctttcaatgataagtttataaggtaaactagtttgatggcttgtagtccgtttttattttttgtacaaaaaacaaaagcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgcaaaagattttgtacaaaaaataaaaaaatgtcttgatgtttggcagcaatcttcttgaggttttactaaaagacgatgagtttgcggatactttctattggcgtatttatattttatgatccttgtgtgtgatttatttatttgtcttttgaggcaatattatagttgccaaagttgtgttggaatagttttattataacttgagtaataatattattttgccttttcggatataccgaatgattcttgttgaaaatactttgtaaagctatttctttattttttttcttaattattgatttgtaatttttatattagtcaatatatgttactgtgattcctttgtgcacttttatgtagaaagtatattaggactaataggaattctattatttgcttaaatatattttaaaatatgctataaaacacttttatcgtgttaaatacaacaaaatgcagatattaatagttaaaaaatattttgcataatgatatctgattttttttcttttaatttgagaaaataaaattaattaaatatttttcatgtttgctatagttggaaatattgttacatcaattttgggtggactactaatatctgttgtagcagtcgctatattgctgtttgttatccatctgttgttccctcgttatttggcaagtgaaactgccttcagcgttattattggatttattctttttatattgattggtgttcaatcttttcttgggtgtggagcttgttctgtaaagaaatatgttgatttatctaatcagaaagtccagaatatgatagagtcggttaggcagataacctgtcaagtaggcgaaaaatcagaaatacaggctatgcttagggaagaatatccgtttgtagaagagtcgttgattagtgaatatttagaagaactgaatatggaacagttgcaagaaaaacctgaaagtatagtgcttggcataaaagcacagctttccagttatatcatacggcgttggatatggggaattgtcttttggttattagctgcaaccgtattgggctacagggcctatcaggatcagaaaagacttgattatttgcgttatcggaatatgatgaatatgtaaccttataaattgtgacaaatatgagtataaaaggaaatgaaaaccatatccttgttgggttgggaggaacaggtggaaaggtcttgaaagcttttcgtaagcgtttgtttcaggaatattcttctgaagaacgcgcaaagctatctatcggctatgtatatgtagattctacacgtgagatgatgcaacccaatgatattactttcagggtattggggcaggatgcttcttttggcgaaagtgagtttgtatatgttcggggagtagaattgaacagtgtctttgctaatcctagtggttttccggggttgaaaggttttatcggtgatccggaagtcatgcagaagacaatagggagtgttgaaacagctgcgggtcagaaacgtcgtgccggacgtattttgtttggaagttcggtacaaaattatttgagtacgttacgttcccagtatataaaggcaaaggggattagcgggaaaaatacactaaatatccatatttttaccggactggccggaggtacgggttctggttccatcattgacgtattggcacagactcgctgtgaatatccggatgcccatattgttttatatgcgatgattccagaacctaccgttcctatgggatgtgatgcagggcgttatcaggcgaacggatatgccgcattggttgaactgaatgcgttgatggctaaaaaatatatgccgtatgatgtgaccggcaaatatgagcgtgtacctttggaaaatgtgaaggcagtagttgacaactgtattctatatacaaacgagaatgagaatggactgaccattgattctcaccaacagttaccgctggtcgttgccgatttcttatacaattatgttttcttggagcagaatgacaatacaggtgaatttatccgtacttattctctggaaaatattgaggactggagaaatgaatttaatgaaaaagctaaagatggggtagttgatccggttcgctctaagaaatatagttcttttggcattaaacgtgtggttattccggaagaagagatcattgaatattttacgttctctttcggtcgtcaggctttgttgcagttacggtataataactggaatgatgacatgggattccgcgatacacctgccaatattgacttccattcttttgtagcagaggcagaaaacctggagcgctggcgtatgaccgacaaacacctgacgctggataaacctattttggattctgaccagaagaaatggaccagctttgctgaatactggggaagtgtaattcctgtatgggcagaagaagccagtcggcagaaaatgcctttaaacgagctggagaaattctgtgccgagggttatgaaaagtatttccgaaaggttggcgtcaagaatttcttcgagggtaaaacacaggctcgagacgaacatgccagtgaaatttgtacgctgatagaggaatatatgtatgataaatggagtacaggtgatctgtctttatataatttgttgcaactgattgaccgaattgtagaaactgtcgatcttaaacgtaaggactttgagggacggattacgacttataatcagcagattgaagaactggaaaaggccaaagctttgaatcagttggattgggcaaataaaggctttattggaggattactttcgaaaaataaaattattcaggctcatgccacaatcatgcaacagctttatttgaaaaagacggagctggaaggtatgcattttggcgtaagtatgctttctgtcctgctgaataaagttaatgcgttacgcggacatattgaacgttttgtttacgttattaatgaatcccttgaagatgcgaataagcagattggtacacgttgtcaggacaaagagggcatttctaatctgaaggaaaccattattcgtttctatgacaatcagggagtgcagaagtttacaaagaatattattcgtgacaaggctcgccaaaaatcaattgctgatgagttccgtagtgaaattataaagttgataggtacggaacgtagttttgcacgggctaatgcagccatttcactggatagtatttcaaatttgctcgatactgtagtccgtcgtaaggttattactatccatgatgaagtcttagttgaaaatacagagaaacttatcaatcggaatatcctggaacagcttaatgaacaatatcggtcagatgatgaactgaaactgtttgcaaaagaactgatagaacagagtggagtattcctgtccttgaatggtacggaactgaatcgtgctgtcaaaaataatccgttgcctcagattcgccataatattgaccggaaaattgtattgatcaatttgccaaaggtagagggaaatgagcaggtacagcgttttgccggtaaattaaaagatgctttgatgaatgctgtgacaggtggagtgctggtaaaagtagacatgaatgggcttcgtaagaatgaaatgacgattgtatgcatggattattgtttcccgattcgtgccgtgaaaggtctggacgttctgaaaatgaaatacgattatctgttgaaggatcctaatgaagcacgccagaaccggattattcttcatacggaaggaacaggagaaaatttccccgatttgtatgtagcaaaagaaaaaatgccatcggaaatacgaaaagagtatactccttatctgatgactgcatttgctttaggaatcattaaatatggtgatagaaatgatggaactggactaaaagcgtatggaacagttgaggtggatgactttggcattgaagtgttgaagcctatggccgataagtttacggaaattccttatgctgcaacctttacggaagagttaggtaaatcatgggaggaacaactgactacagccttgcgtacggattatctacatgtagataagcgtaaagaactggttgccaaaattcaacatttagtaaaggatgtcattttgccagagtgtggcggtaatacaggcgctgaatcattcttgttcttcagagaggctggtttgaaagcacttgagttggttaaatagattaaagaatatgttacatgaaacgaatctgtcatataatgattggaatgattatatggcagattcataaaatagatcattatggtacagaataaattgaataaaaaaggacgttgcatgaatattggcaattgttcgaaggctaatgctaaagaaatcatagaagttggaattggagaagattttatatgtcctgaatgtgggggacaattggtagaagtaaagaagattaacgtgcttccttacatcataggaggagtggttgttgttgctctcgttgtagccgggattgtttggggccctcaggttattaatgactttaagacggaagaaaaaacagttgttgaaccggatacggtagaacaggttgaacaggtaacagaagctgccccagagcaaacggctgatgaaacaactgcagagtacaaagatataccagtcgaaacggctcctgttgtcagtgttcagaatgggcagggaacaattgattttggttatgcgaaatatgaaggaagtatctctaacgggaaggcgaatggattgggtaaattgacttatactcaaagtcgtcggatcagtaagagagatacccgaaaccgagttgctgttccgggagattatatagaaggtagctttgaagataatgaacctgtaacagtaaaatggtacggctctgataagaagctgaaaggtgcggtaatgattggatcaaatggtctttaactgatataatctattttgcttatgtttccttttcggagtataggagtagctgttatgttgtgtgtggaaagtcttgcttgcgcacaacaaggaacgagttcaggacacttgggcttgttacgtcgacagctggaaatgcgtaaggttgctttagtcacagattcatcattgcatttaaaaagctgtcctcagaaggaaatgtatgtgttaatggataaaaatgagttaaagaaagcaggattgaaactttttcctgttgaaatggaaaaagtttttcatcctgctgtatacgactttattgaacgtacctttttgcatttatcattgttgcagatgaagtcacagagagaggtgctattgcggcaagatcaattgtctttattggtgaacgggctaaattataaggattgttctgtcgatttttgcagtattttaaatgcattggatttaaagtatcctttttctcttacagacgattcaacaaggtatcaggcttcttggcaaggagtcggaatgaaagtagatttgcttttcccgaagcagtatgatttgctcttgggatatgataaatatgagttgacacaaaggctcattacaaacctgagtatccgtcagactgattttcggaacgctcctgtgaagtggaaagaatcatctttacagaagatcagaggaaatgttttctacgatcgaggagatgtttttatgattcctcagatgaagagtggaacctatctgatgaagaaaggaacagcatggagttatctttttaatgcttatttcccggaggagtcagtattgaacttattttctcatgctcatcaaatgaattttttgttacctttttccttggccgtgaaaggatataattcttctgcagcaaaaagtattggcttggctgattttgtttctttgatgatatcggaaggatgtcgcccttacgtagggattgaaacgatggatagtaaacagataacaggaactgttatatacctgaaccgtgatttgatgtatgagcatttgctttacttccagttgccgcttgaggtatttcataaaaaagataatgtaaggataaaagctgtattgtatccttatattcctttgaataatcttgagaatttgtatgccgatgaatctccttctgctgttgttcagtcggctgatttttcatattaatttaatatgtaacgtgtcatgagaaaagtgcttgtatatatccttttgttgttttgtcttcctgtttgtctttctgctcaagtggcgtatatggaagaaaaggcaaaagtaaataagatcaagagaagctccctatatctctatggtgaaggaattgcggctacggtagaagaagctacggctatggctgaaacgagtctgaagaatgctattttatctgaaatgggcgaaaatgaaaagcttcaggattcggatcagattctgataaattcaataaaaaagcattctgagaaaattcagttaaagcgtggggctatggagcgtgtatttctgtacgtagagaagaaaaacttactctcgtccgataaggttgttgtactggatgtttcttcttctacagtaccatcacaggaaaagcctgcgactgaagaagcgaaggtagatgattccgcgccttcgggtacaagctcttcggaagtctttactcccgtttcagaacaagtacctccaatacaaggtgaaaaagtgaaggtagatagtccgttactacaggaattgctggagcagaaaacggtagatggtctggagctgtttatgaggattcagaaggaaaatcataaactgatgtggggaaacgtaaaatcttcactgaatccatcttggtatatagtggttttttctgatacaacgataaaggctgtctttgataaagagaaaaatggggtacgtgttaatttgttgaatggaaaagaggaacaaatgtctttatataataccgataataaagtctggtttattttatatgaataaaaaataatataaaaatgaaaaagataattgctttaggaatttgtttgtgtatggctgtattggtccatgcacagtatgaaacgactttgatcgtaacagatgctccaagcactgctgtaaaagcaagaatggaacagaatggtacaaagctgctgacggaattaaataatgcgcaaggagagaaccggaatctatctttggctggaattaacatcaataatcaggctgctgaatctttgatgataatgtgggaggtttgtcctttccgttgcgatgaagtggaaatcgtagagcgttgtttgcatattggaaataatcaaggtttgcaggtccgtaatattcctgttattatggagcctcgggcaggagaacgttttgatgaagaccagtatcaagaaattgtcttgaactttgacaatagtggtcagattacaaatctttgtttctctattgcacagaatctatatactcaggttatgagaagtaatctggaagttactgatttacgccgtcgttcattggtcttggattttgtagagcagttccgtacagcatataaccgcaaggatatggcttttttggaggatatttttagcgatgatgcattgattattactggaactgtaagaaaacgggtgaacaatgacggtgtacagtttgtttcgggagtttcttataaagtacaagataagcggacttatttgagtaatttgtcggctgtattcagaagaaaccagcgtatcaacgtggtgtttgacgatgtaaaggtgatgaagcatcgtcagaaagattatatctatggcgtgaagttagttcagcattggaatgcagatacttatagtgataaaggatatttgttcttgctttgggattttaaagatgaggctaatcctaaaattcatgtacgtacctggcagccttatgatgctactccggagaaagaggttttcggtttgaactcgtttaatgtgtcgaaattatgagaggtgtagtggaatataggatttatatcttggcttttgtttgtctttgcctgtgttctttgtcggctaaagctcaggatattcgtattactcgtaccgccgataagtcgtatccggatcagtatatggctaaaattgaatttatttcggcttgcgataaattggaatttagtgaaaatacgggcgtagaagtttcttctcctaaaatgttgaatggtaaatacgtatattctgcagttttggatgttgcagatggaggtagcttgagctttatgatttggaagcggggtagtgtggacaaaaaacaactggatgtttcattggaagaaaacatgtgggcttcttttaatgtggaggtcgtagagcttccgctgaaaatagaaagtgtggaggttacggctccccatatgactcatgcaacgccacaaatggctttgatttcggttgtaagtaacagtgaggaattacatcttgaattgttgagggatggttccaaagcagggaatgcgaagttggataatgtagccggaaagaaagatggttcgtttgagtatttgtatcatgttaatttggctgatgtccctgcttctgctaactatactcttaatttgtcggttagtgataatccggaaatgaaagcatttcagataggtaccttagctcaaaaggatggtgtagaacttgctgtaagtgttaaacaagaagcttcttgttttcagcatagtgagagcttagctgaaaatgcatttatcaatggtttgtatcgagatgcttattttgcttataaggatgccttggaatgtaaagataaacaagatgagggaattattaagaaaaagatgaagaattcggctattttgtcgaatgcgaaagaacgtgtcatgaaccatgtagagaaggctgaaaattttcgtcaaaatggtcagatggatagttgtatgttctattatcaggacgcaaatcaatatgcggcagctatcctgaaaatgaattcaaatgattcatattgtaccaaattacgtcgtgatttttcacgtatccgtaaagaacttccccgggttgtttctggaaaagttgtcgatcgagctaaaatggatttgaataagaaaaatcctcctttggctaatgtatatgtagtgctatgtaaatatggagtgaagtataagaaaattgatggagtttcagtagcagagcccgatttgaaacagcttcttgaaacaaagacattggtaaaaacagatgcaagcgggcattttgaagtctttgttccaagagatacgagtggcggtgtctatgtcctccattttgtggcagatgataaggagatcggcatttcatcgatagatgcggtaagttatcgaccaaccgatgctgacatacaaaaaggagtagtagtgcgctttatttcaagtaggaagattaatgcgaattgatataattatttatttaatgaaaatgaaaaggctatgaagaaatgttttttaaaggccgttttacttgctatagttgcggtattttgtttgggaacggttgcgcaggctaaagacaagaaaaagaaaaaagagaaaaaagaatttgtatggaaaatgccggaaaaaatgactgggattaaggatttcgatacatatcttttaacttgcgataccttgtggaaccgaattactacttatcgtgattctattcacttttttaagatcgatacagttttggtttatgataagacggataatactccttattatgatatccagattcgtgatgaagaaggtaccaaaagaagttgggtacagtctttgcagcaaggagctgatatgatactaagtggtactaatatcgtactagatgttgctaatatttcattgttaacggtatctgcaggagcctctttaacggaaaatccattgctggctttttcacatggaaaatatttaaaggctggtcctaaaattgtggggttaggctatcaagaagttagggaaatagtgaaccgtaccaagcaacaaatgcgtacgatgaagcagattcaccaaagtaaggtagataagtcaactgatacagattatttggtagaaataccggaaggaacggaaattaatctggaggaatgtgtagatttggctactatagacatggggacttctccggcgcaggagttacctgagttactagctaatagtgatttggataatgatttggaagttcctgaagagaagaaggattagtatttatctttgtctgataaatacttaggagttgtaatcgtattgaatgactcacaaaagatggcgtgaaagtccttttgtgagtcatttttttatttagaaggttcaaactgaatatttgtaaatactgattttagaatgaataggttattgttccttataatccccatttgccttaatcagttcgatcagtttttctacagcctgttcttccggaatgtttttctcgatacattcctttttcttgtacaagctgattttccctcgtccggctcctacataaccgtagtctgcatcggccatttcaccgggaccattgacaatacatcccataatgccgattttcagccctttcaggtgagaggtcgcagctttgatacgggcaatagtcgcttccaggtcgtataatgtacgtccgcaaccgggacaggaaatatattctgttttcgatgtacgtgctctgcctgcctgtaaaatgccaaaagctgtttcgtccactttggtatcggcaatggcctttccgtgattatacagcaagataccgtcgcagaagccatcgaagataagagctcccatgtcggttgccgatttgatctgtaagtcttcggtgttgtcttcctgatagaactggaaaaataccaatggattggtcagtccttgattcatcaattgatgggcaatacctcggaactcaccgagtcggttggggtgattgctttgggctatgatgacaacttccggatgtagtcgcaggcaagctgtagcctcttcattcagtcccatatacggagtgaataaaaatttgatttccgcattgcagtgatgcagttcaactaattgctggtaattgaatgccggataagtacctttttctccgttccagatattggcatctacaatgtaacctgtatcggtacggcgtgcttccggtagatgctggccgcaatagatgtaatccggacggaattgttcatcaacttccatattgtcttccagacgggcagagataacaaccggaacttgttctcctcctatgttcccgacagctgttgttttgcgtcgactcggattggtatagttgaattcaggtgcttctgctcctggaatataaggatgattctcgcgctggagtacataatccaccagtttacgggctacaggaatttctgcttcgggggcttcactcaatgatacacggatggtatctcccagtccgtcgcataataatgcgccgatgcctaatgccgacttgatacgtccatcttctccgtcaccggcctcggttactcctaagtgaagaggaaatgccatgccttccttttccatctgttcaaccagtaaccggacagtcttgaccattacgaccgtattggatgccttgatggagatcacgacgttcgtgaactgttcgtctacgcagatacgcagaaactccatgcacgattctaccatgccttcgggagtatcaccgtagcgtgacatgatacgatcggacaaggaaccgtgattgacaccaatgcggatggctgtatgattctctttacagatattcaggaacggaatgaagcgatcgcgtattttctgaatttcctgagcatattcttcgtctgtatattccagttttttgaatgtacgtgcggcatctacatagtttcccggattgattcgaactccttcggcatacaatgctgcaacttcggccactttgggattgaagtgcacatcggctatcaatggagtgttgtaaccttgtgaacgcaagccgatattgatgttcttcaggttttcggcttcgcgtactccctgtgtcgtaagacgtacgtattcaccacccgcgtcgatgatgcgtttggcctgttctacgcatgcctcggtatccatggttaccgtattggtcatactttgtatacggataggattagtgccacccataggagtggcaccaacgtatacctcatttgcctctcggcgtgaatagttgaagtaatccattaatttgttttataagcgtattttacttctttcagttcttcgtttgctttaacaatcttgtttttcagtccttccttgtaagctgcgaatttagctgcaagctcttcgtcggacagtgacaacatctgtacggcaaggatagctgcattcatggcaccgttgatagcgacagtagctacaggtatgccgggaggcatctgaataatagaataaagtgcgtctactccatccagaacagagccttttacaggaactccgataaccggaagagtggtgtttgctgcgataacgcctggcagtgctgctgccattccggctgctgcaatgatgaccttaagtcctcttcccgcagcttcttttgcgaacttttctacttcggcaggagtgcgatgtgccgagagtgcattcatctcaaaaggaacttgcatttcgtcgagcagttttgccgctttctccataacgggaaggtcggacgtactacccatgatgatacttacaattggtttcatgtttgttatttagttttactcattaatgatctgtttgtatgcttcggcatccagcagttcatccatttcggttgtatcggttggcttgattttgattatccagccttcgccatacggatctttattaaccagttcaggatgttcttccagtgccgggtttatttcaagtacttctccaccaatgggaaggaaaagatcggatacagtctttactacttcaatggttccgaatacttcacctttatccaaagtttcaccttcagttgttacgtcgacaaaaacgatgtcgcccaattgatcttgtgcataatcggtgatacctacataagcttcctcaccttccaggcgaatccattcgtgttcgttggtgtactttacatttgttgggaaattcataatcttagtattttagaggttaatgtttaattatcatgtttcaaataaacaaaattccaatgataccacaaaataaaccgactaaaaaaccgccgcctacttcgtttaaagtatgttgtcggacgatgattcttgccgaacccagcattcctgccagtaagataaaaccgcatagccaccagataggattaaactgaaagatgaagctgtacgagagcaaaccaccaataatcattccgcagcttgccatgtgtgtactgattttccatttcaggttgatactggtacaaataatcatgcacagcagcgtggcaatgatgatgccgctcatgtagcgtggcaggtgaatgcgatacattgtcaggaagcatccggtatagctcatgatcgtaatcaggtaaggaatgaaacgtttctttctgttccccagttcctgcagggtccacccattgattttctgaagcaggtagatgccgagcatcgggagtaatatggtaaaacaatataccataatcaacaccgtcagtttatattgcaggggaagaacccgcaaataggtaaagaaaaagagaagtagaaacgcgacaaaaggaaccatgaaaggagtgaagacggcagagataatgcgagccgctataaagagcttgtccctctgttcttccttgtttctgggttcaggatcatgatatgtcagttggtcgggaatatttgtttcttccattcttgtgataatatttttgttgtcgtttcatttatctccttaagcgtgcgacggggatattcaattgctggcgatatttggcaacagtccgtcgggctatcggataacctttttctttcagcatgtcagccagttcgtcatcggtataaggcttgtctttattttccttggcaatacattctttcaggaactgcttgatttcgcgtactgaaagttcttctccactttcggttacatatccgtcgctgaaaaagaactttagcgggtagataccgaaatttgtttgtacatacttgctgttgcttactcgcgaaatggtggaaatatccagtttggcacgttccgccacatctttcagaatcatcgggcgcaaagaggattcatcaccatcgagaaaaaatggtcgttgcaagtcgatgatagcctgcatggtgctgagcagagtttgctgacgttgtttgaccgcattgatgaacccctgtgctgcgtctaccttttgcttcaggaacatcatggcgtttttcgattccttgctctgatttgccttattgcgtgtatgttcatccagcatttctgtaaactcacggctcaagcgtaactccggtatattccggttgttgaggctcaggttaatagttccgtcctcttctgtttcgacaatgaaatcggggataatctgttgtaaattcttgccaatggtttctcccatcgaactgcccggacgcggattcaattttgttagttctgctacggctgcattatattgttcctcggttatgttcagcttttgcagtattttatctttgttcttcttggtgaaatcgtcacaacatttgctgatgatatcgtactctatttgttttaacggagaattttccttccgcttgatttgcaacagcaggcattcttgcagactgcgtgcgccgatacccgccgggtcgaaatcctgaatgatagataagacatgctccagctgttcgggagtggtagaaataccctgataaatggcaagttcatcaatcaaggcatctgtcgtttttcgcagcagtccgtcatcgtctaatgagccgatgagatattctcccagttgtttttcttcgggagtaagttcctgcatgtcgagctgctctttcaatgtttcgtaaaacgatacattgtccgaaaaaggaatctcttcgggagtttctcccttggaacgattgttctcctgaagtttataatctggaatgtcgtcttcggtacggtaatcacctaatgataaatcttcttcatattcgccggaagttggctctccgtcttcatccgtagtataatcgtcttcatggtcgtctacctgttcggaaggttctttaccttcttccaaagccggattgtccaaaagttcggagtgaatacgttcctccagttccacagtaggaagctccagtaatttgacagccagaatctgctgcggagataaagtctgcacttgttgctgagcctgcgtttgtacctgacgtgaatttatagccataaaaaagaatttgatttatcgctgcaaaaataacaaattaggtacggattacatgaaagtgaacttaattttatttgtgttccgctatgtaatccgtaccagtataattaaaaatcagtatctgaagctgcttcctcccaaaaactcacgtaacaatgaggtaggaggtaattccttgtcttgtactgatacgaaatatgacagaaatcgcaagagtcggtgtgcttccgaatatgcagagcagttgttgggcaccttacgcaaaagtggttctgcatagtctttcaatacagcgagttcgaaaagtaaagccgagttaaacattgcgtcggcatattcctgataggggaaaatccatttgtcttctccagcgcgtacactttcccagcgctcgatggttgcttctgccgaataattgcgataccggtgatcacgtatgatacgtcgtaacagtcggttgtctgtcgtaggtatatagttatggttatcgagtaaaatcgttgtcagtgccgatacgtatattttatatttattctcagccgggatattcggggtaagtgcaggatttaacgcatgaataccttctaaaattaaaatcatgttatcgttgatgcgtaactttgtaccactattttctcgtttacccgttgtaaagttaaatcggggtaattctatttccttaccttccaaaagatctttcagttgtgcttcgaagaaaggaaggtctaaggcatacaacgattcgaaatcatgttgtccgttttcgtccagcggagtatcttccctgtttacgaaatagtcatccaatgaaatcggatagggcttcatgccgttggtcatcagctggatgctcaaacgtttgctgaatgtagtctttccggaagatgacggaccggaaatcaaaacaagttttactcttttcccgttttggttccggtgtgtaatttcatcggctatacgagctattttcttttcttgcagagcttctgaaacctttatcaggtcagtagcatgcccttcattgcaggctatgttgaaatctcccacagtactaatacctaaaatttgattccagcggtgatattcttggaatacttccagcatcttttcttgtttcacaagttcttccaacttcttgggatttttccggttaggaatacgcaacagcaagccatcgtaatattttacaatgtcgaatagtttgatatagccggtacttggaaccagactgccataatagcaatcgatagtatctcccaatctgtaataaaaagtgtacaattgccccgatgttttcagtaatttggctttatccagcatacttctttgactgaataattcgacggcctgctccgtgtgacactctatgcgttggaacggaatatcctctgtgatgatttcctgcatcttttgtttgatacgagttacgtcgtccagtcctatcgggcgatcgaggtgtaaggtacaatagtatcctttcgatacgggatgttccaatgaaatactaccttgtggataaagctcttctactgcctttactagtatgaagcagagtgagcggaagtaggtacgcatgccggacgaactggttatatcgagaaattctatgtctttgttgtaataaactttgaagttaagtccctctactttgttgttaactttcgcactgacaggtccgtagggcatagatagattaaaaccattataaatatccaaaagcgtgctgccttcgggaaaatcttttgttaaattgttatttttgcaatatatttgtagcataattgtaatatgtgttactaacgtggtgatttggcaattaatttacacattaaacaattaaaagcctacccccgacttaattaattacaaatggaatatactttttatgattttttagcgttgtttggttcgttagcgcttttcctttatggaatgaaaatcatgagtgaggggctccagaagtttgctggtgacagacttcgtagtatcctgactgccatgacaactaacagagtaaccggtgttctgatgggtgtgcttattacagccttgattcaatcttcttctgcaacgacagtaatggtagtcagctttgtcaatgcaggattactgactctctcgcaatctataggtgtaattatgggcgccaatatcggtactactgttacagcctggattatttcggctctcggctttaaagtcgatatttccatgttctcattgcctcttctggcattcggtattccacttctattttctcaaaagagttcccgcaagtctgttggagaatttatctttggttttgctttcctttttatggggcttaatcttctaaaaacaaatgcccccgacctgagcgccaatcccgatatgttagctttcgtacagaattataccgatatgggttttctctctgtactccttttcgtttttattggtactattctgacgatgattgtgcaggcctctgcggcaacgatggcaattacgcttatcatgtgtgccaacggatggatcagttttgaactgggagctgcattggttttgggagaaaatattggtacgaccattacggcgaatcttgctgctctgacagccaatacgcaggcaagacgggcagccatggctcacttaatgttcaatatatttggtgtggtttgggtattgattctgtttaagccgttcttgtcgatggtagactggattatttccgatttcatgcatatcagtgaagccgatggggtagccgtttcattcaaactttcggccttccatacatgttttaatgtgtgtaacgtgttgatcctgatttggtttgtcaaattgatagaaaagaccgtttgtaagttgattcctcagaaggaacaggaagaagaataccgtttgcagttcattacgggcggtatgttgtcaactgccgaattgtctgtcttgcaggcacgtaaagaaatcaatctgtttgcagaacgtattcagcgtatgtttcgtatggtacgcgacttgttgcatacggaaaacgagaatgaatttaacaagctgtttagtcgtattgagaaatatgaaaatatcagcgataacatggaggtggagattgccaattacctgaatcaggtatccgaaggtcgtttgagttctgagagtaaactacagatacgcgaaatgcttcgtgaggtaaccgagatagaaagtatcggagatagctgctataatctggcaagaacaatcaaccgtaagcgtcgtggaagcattgacttcacggaaaagcagtatgaacatattcaccagatgtttggattgacagatagtgctttgacgcagatgattgctttggtagaggatgtacatcatacggtggatgtgaataaatcatttaacatcgagaatgagataaataattatcggagtcagttgaaaaatcaaaacataattgacgtaaataataaggaatatagttatcagatgggcattcactatatggacatcattggtgaatgtgaaaagctgggtgactatgtggtaaatgtagtagaagcgcattctgatgtgaaagagaagaaagcttgaggaatttgaatagttataatgaaaacgtcgccatgtttttttaatgtggcgacgtttttttgtctttctgccgataaatttgatagaacgttagtgtatttgaggaatgcgtgttgtgcagattattcaagcatatgtacgtcttgttattgttctattgggcaactgatcatttatttttcatggctggtacgacacgctttatccaatagatgaatgtcagtaaggccagtatacctcctacatatcctatcccagagagagaaaaatgtgtgtagacagtgccgcctatgtaagtgccgcaggcgatgccgagattggtcagaccggaaaatatagatgtggatacggctgtggcgtcgagtggggaataattaatggtttcggcctgaagggttacattagaagctgtgaacgtcataccccataaagcgcatagcagaatgatggtgaagctatggaaagaagatgcgtggagcaatatcagacaaccacagaggctgagaatggctatgctcatgaacctgaaagggttgattgaatagaatttactgaagcatagactccctaatatacccatgcctccgaatatcattaatgtagccgtaatccaactgtcttgcatgcctgctatttgctttagaaaaggttcaatataactgtagccggtgtaataggaagtggcaacggcaaaagccagaacaaacaggcgtgacaaagcaggtcttttgagtagtatggggagtttgtggagtgaaaagttgccacggctgggtactatgggtaatacggataggaggtatatgatcagtgcgaaagcaaatatgccgatatagagaaatgtcatacgccatcctatttgcagacctattattcgtccgataggaagtccgaaaatcatggcgatagaggttccggtagcaatcatgcttaatgccacattcttaaattgagtaggcacggtacgtacagctaatggggctacgatggaccaaaatatggcgtgtgaacatgctacacctattctcgaaatcataagcatgacgtagcttgtggacatggctgataaaatttgaaagacggcaaaaactagaattacggaggagatgagtttctttaactcaaatctggatacaagtatcatcagtgggagggaaagaatcatgacagcgaatgcatatactgatatgagcattccggcttttgtgtcggttatggcaaaatcacgtgcaatgtctgtgagtaatccgatggggatgaattctgatgtgttgaatataaaagtggagcatgttagcccgatgagtgacatccagttccttatagttagtttgtcttccatttttgtgattacctttctgataaggaatttaaattacgcaaaatagcaattttgttttgtttggttgggataataaaaaaatcctgattctattaggaatcaggattttttagatttaaagtggtgccaccaggaatcgaactgttgattcaagtggctgaatatctttgatttatctttctgcaagtagtgtaatctcccgctattgctccaccggattgttgcagcgttctgcgtcaggttgcgtggaggtttcctttactgattacaaatatacgacttttttctgtatgtcaagcatataatcgtagaaacttctccaccttggttcaaaatcctttttggacttcccaataaccgcctttatccggtcctatacgcttaattgctcctttctcttggagtgaagctaatcgcctttttacactgctgtcgtgtagtcccaatcgaccagaaatctcttttcttgaaatgtagggattccctttaataagttcaagaatagcatcttcctgtttgctttggtcgttttctggtcgttttctggtcgttttctggtcgctcttttgggtcgcattctgttcgtattgggccatagctctttccgggtactcaaacttaaaaattgtccatatacccgaagcgtcatagcggaactcgggcctggagaaaccatcattcttgcaagccattatgatacgctcgatgccgcgcccccacgcctcaatctcacctgcacggaagaatgtgttggctatatcgggattgtaaggcatactccgatgagaagacaataatgtttctacagtccatccttcgggcaatactccaccgtttattatctccaacttgttttcatacacgcggatttggatgggagaaggttctgcatagtctttgttgatgcaggcatttaataacgcctcacgcagagcctcacgaggcataggcaatgtttctatccgttggatgccctcgtaggtaatgatggctttcatgtatttggtacatagtaagtccatcagtttcacaatttgctggaacagattaccatgcacttcgtcctgatacaccaaatccatgccttcacggaagaagccgacctttacaaacgctccggttacgtattgttccgggtcgggatggaacaacaaagcggcagcacgtttcaaataattgccttcatagagccgcagtttctccaacagtccgtgattgtcgtccatcaagtccgcttcctccatgcgtccgctccgcttggcatacttgcggaacaaatcaaacgtagtgttgtccaagtcctctgctttcagataaggtaccggcacaccgtcccatgtcttgccttgcttgcgaagcatgaagcggtcgagtgccgctcctttcagttcctgattggtcgcaccgctccgttggtaatactttcctcgaaaactgatgggataaggataagcctccgtcacaatctccagatattgtttttcgtccttttctttcaaattgacttccaccaagattcccatcatgtcacgtaccttgttcgggatgtcctccatcaacttcttggcatcctgtataccgcacacttcaccattatcacgcagaccgatatacagtgtaccaccttgtgcattggcaaaaccacaaatccatttctggtattcatcacgccaagattctttgaattctatgtttggggattcggtattcatgttttcctgctgaacgacattgcttatatgccccaaaaatacaactttttatttaataaaatcatctcatatggaaggaaaatgaaatgaaatcactatttttgcattatatctgagttttgaaatatggaagcaagtaagatgcgagatattaatcggctgaaaatattgttggcagaaaagaagaaaacgaacaagtggctgtgtgagcaattgggagttaatcctacgactgtttcaaaatggtgtacaaattcatcgcagccaagtttggaaatggttctaaaaatgatggaagtcttggatgcggacataaatcaaataatcaatttgccagaaagagggcattaaacagttgcttttgcttaaagtatgatttcaggcctacattaaggctctaatctaaacttcctataatataatgttatgacaatatggtagataaaaagacgttgacagaagaagacatcaagcgtttgtttatcacaaaagccatcaccaaggcaggatgggcagacgaccaaataaagatggagtattactttaccgatggtagggtaatatttgaaggaagcacgcatgaccgtcaggctcgaaagcgtgctgattatgtcttgtttgacagaaataattaccctattgccataatagaagccaaagacaacaagaagcctgttggtggaggtatgcagcaagcaaaagaatatgctgaaatccttgatataaaattcgcatacagttcgaatggggatgctttcttagaacacgattttcttacaggcagtgagaaagaaattccattggagaaatttccttcaccggaagaattaaagaagcgtttggctgcttctgacccgttgacagaagtggaagaggaaataataggtacaccctattattttgatgcctattcttatgagccacgctattatcagcgtattgccataaacagaacaatagaagtaattgcgaagggtaagcaacgtatcttaatcgtaatggcaaccggaactgggaaaacctatacggcctttcagataatttacagacttcacaaatcgggagctaaaaagaaaatattataccttgctgataggaatatcctcatagaccagactatgacgcaagatttcaagcctttcaagaaaattatgacgaaagtgaaggattgcgaaatagattccgcctatgaaatatatatggctctttaccatcaacttgttggtaaagaaggtgaaccagacccatttgaacaggtgcaaccgtctttctttgatttaattatcgttgacgagtgtcatagaggaagtgcaaaagatgattcggcttggcgaaaagtattggaatactttagctcagccacacagattggcatgacggcaacacccaaagcggctgacggggcgaataacttggattatttcggtaagccaatttacacctattcccttgtacaaggtataagggatggtttcttggctccttatcgggttaccaactgcttcatagatttagacttgcaaggatatactccccaagaagacgaattggatatttacaataaaccgatagaacagcgtttttatcagcaaaaggattacggacgcgacatttcatttctgaagcgtagagtattggtcgcacaccgtatcacacaaatgcttcatgaaattggacgaatgacaaaaacgatagttttctgtaccgatatagatgaagcagaagccatgcgcagtttattgaccacgatgaatgcggatttatgcaaaaaagatagtcgatatgtcatgcgtataacgggtgacgatgccgtaggaaagaaacaactggataatttcatagatgttgaccaaccatacccgactgtagttacaacttcggagctattggcaacgggagttgattgtaagacgtgtggtcttatcgtcattgacaaggaaataggctcgatgacagaattcaagcaaataataggtcgtggaactcgtttgcgtccggacaaaggcaaatggcatttggagattttggatttccgtaatgccactaagaaattccgtgacccagagtttgatggattacctgagcctaagattacaggtaaaaaagcaaaaccttatccgcctgtacctcaaaatagtggaacggtcagcgaacctcatgtcaagtacatagtagagggtgtgccttacaatatcacaaccgagatagtttctgttttgggtgaggatggaaagactttaaggacagaatctgtcaaagcatttacgagaaaacagattaggaaacattatgccacgctggatgatttcatacacaaatggtcttctgctgaccgtaagaaagccattgtagatgaattgaaggaattgaatgtgcttgttgaggctgtccgtgaaaagaatccggctcttgcggatgctgacatctttgacattatttgccacgtggcatacgaccaaccaccacttactcgcagagaacgggctaacaatgtcaagaaaagaaattattttgccaaatatgaaggcaaagctcgtgaggtgttggaggcattgcttgaaaagtatgccgaaaatggaattatggattttgaggacgtgaacatacttgaccatgctccgtttgacgctattggtaagccacagaaaataatgaaactgtttggcggaatagccaattttgagaaagcggtcaaagaacttgaagatgaaatttataaaaatgtagcataacaacaatggctgtaaataacatagtaaagcgcatccaaaacatcatgcgtcaagacgcaggtgtaaacggtgatgcgcagagaattgagcaaatgacatggatgttcttcctgaaagtatatgatacgcaggaagaaacatgggaatacaaggcttgtcgtgaaggcaagacatacgtttctatcatccctgaagaattgcgctggcgcaattgggctgtggatgaaaaagacgggaaagcacttactggtgacgctctcttgtctttggtaaacgacaggttgtttccgactttaaaaaatatcgaagtgacacgggaaactccacgctccaaggctattgtgaaagatgtctttgaggacatcaaccagtatatgaaaaatggcacgttgctcagacaggttataaacgttatcaatgaaatagaattcgatgatgcgcaagaccgtcatttatttggggatatttatgagggtatccttaaagacttgcaatcagccggaaatgccggagagttttataccccacgtgcgttgaccgatttcattgtagaaatgttgcatccgcgtttaggtgagacttttggcgactttacttccggaacaggaggctttttgacttcggcattgaaatatcttgaacctcaaattaagacggcagaagatggaaaattatatcaaaatgcggtcatgggtcaggaatggaagcctttgccctatttgctttccattacgaatttgcttttgcatgatgtggaggcacccaatatccgtcactgcgattcgcttgctaccaaagtaacagattttactggcaaagacaaggtggatgtgattggcatgaacccgccatacggaggcagcacggaagccagcgtgaaaagtaattttccgatggagatgcgtagtagtgaaacggcagacctttttatggtgctcattatgtaccggctgaaagcaggaggtcgtgcgggtgttattgtccctgacggttttctctttggcacggatggagcaaaattggctatcaagacaaaaatgttgaaggattttaacttgcacacgattatccgattgccgggaagcattttttctccatatacttccattgccacaaacattcttttcttcgataatgaaagggcggaggatgctccggaaggatattccaccaaaggcacttggttctaccgccttgatatgccggagggctataaacatttttccaaaacgaaatccatgaagttggagcattgtaacccgattaaggaatggtggaatgaccggaaagagattatcattgatgacggtaatgaaaaatctcgttatttctctgtggaagaacttattgccaatgattgtaacttcgatttgtgtaaattccctaaagacgaagaggaaatactgcctcctgccgagttgcttgccgattattacaagaagcgtaaggcacttgaccacgagatagataagacgttggctgaaatacaacggatattgggaatcgaattaccacaggaataagaatagcgtgctgcttgtaacaattgaaatgagcataagtatgaaagacttaacgacatccaatatagataggcaaaacatattaaacaaccgttttgcagttgaaaaggtgcaatcccaaataggtgtcacgggtatgcttttcaatggggaatacctgttcactaaacaaatggttgcggatttctatgaagtggatacgtccacaatagaccgttatttgtcatcgtatggcgaggagttgaagcacaacggttatattttatgtaaaggtaagtcgctgaaagagtttaagttacaatttgctcacctcataaatgaggcgagcaaaactacccaacttggcttgtttaacttccgtgcatttttaaatataggtatgttgcttacagaaagcgataaagccaaacaagtgcgaagcattatgttggatttagttatatctaccatcaatgaaaaaacaggcggtggcactaaatatatcaaccgtagggatgtcaattacatatctgctgctatcacagaagaaaattaccgaaaaaatctcacatcagcaatcagccagtgtgtaatggggcatgtcacttacaagtattccttaattacagactatatctataaagctattttcaaagaaaacgcaaaggaatacagggagatactgaaactggatagcaaggacaatgttcggcacacactgtatgcagaagttcttcttgtcatttcctcctttgagaatggtgttggggctgctatacgagaacagtataaaacgagaaaaaagcgtcttactgttgaagaagtgaagtgcatcattgatgaactcgcagaacatcccatgcaaaaaccttacataaatgatgcccggacaaaaatggcttcaagggattatagcttccgtgatgcttatcatggcaacattgcaaattatttgagagccgtaacccctgaagagtttgaacggtttattggtgaccagtcgattgattttgaccatatcttggcagagaataaagatgtgctgaaacgcttaaagcaggcggaagatgaatgaggaaattatttatattgactacgatgaggtcttaaacatctatggcaagatgatagatgccagcgatggaggctttgaaggagtacgtgatgaaggaggtattcgtgctacacttgattttgtgcagaacgatttgtattacccaacatttgcggacaagctgacctatcttatgtatagattttgctccgggcatttcttcaacgacgggaataagcgtattgcattgactcttggggcatacttcttacacaagaataattactattggcacgcttgcatttgtatgcgtgcattggagtctattatttatcacgtggctgcatcaaatatcgaccaagatttattgttacgcatcataaacagttttatgacaagcaaagactatgatgaagaattgaagatagatattgccaaagccatgagtaagggtaatttgggtattgaaggtgaggattacaataaaaaagtttgaaaatatgaagactataaaaataatattactgcttttctgtattgttttagggcttaacactaaggcgcaaacagtaggttataattataaagtactcgcagccgaaggttgtaacatgaagtatagtgtatcaaagcaagataccatttattcagtagttgctacagtacgttcagacagaatgaattttctgaatgagcctaccatgaaaatcagaacttttacaggcaagttgcttgaattgaaaggaactgtaattggtaatggcagtcagtctgttggcataatcagtggaaatattgtatccctattacagaaataagttcaactgcccaattcagaattgctccacaacaatttgaaatcttgaatgaaggtgtggctaagattcgtttgtctatgacaccgatgaaccatgaacgtactttcaagaaagataaaatagggaaaaagctatataagttctatctgaaagagaagcaaaaggacgaagaattctaaatctgttggaataaaatgaacggaaaacaacttaaaaacagcatactgcaatgggcgatacagggtaaacttgtaccgcaagaccccaatgatgaaccagcaggcgttcttttggaacgtatccgcaaggagaaggaacggcttattaaagagaagaaaatcaagaaggacaaaaacgcatccatcatattccgtggtgaggacaattcctattatgagaagttcctcgccacgggggtggtgaagtgcattgatgaggagattccgtttgagattccaagtagttgggaatggacacgcatatcgtctatatttcaacttaatccaagggtagaagccaatgataatatgcttgcagcatttattccaatggaagcaattagtgctgtatatggttcagattaccattactatgaaaggaagtggaaagaaataaaatccggctttactcagttcgctgacggagatatagcatttgctaaaataacgccatgctttcaaaacaggaaatcagccgttttctctaatttaccaaatggtataggagcaggaacaacagaattaaaagttttacgtccatatggggaaactataaatcgtttctataccttgtatttccttgaaagtccatactttattgatgaagctacttttaaaggtacagcaaatcaacagcgtattgttgttgggtatttggaaaacaagctttttccgttacctccaattgaagagcaatgtcgaattgccggtaaaattgctgaagttttaccgatagcggatagatatggcaagactcaaacaaaacttgataatctaaatgtagaattaaaaaatatacttaaaaaatctgttcttcaagaagcaatacagggcaaacttgttccacagatagaggcagaaggcacagcacaagagctacttgaacagatacaacaggagaagcaaaaacttgccaaagaaggcaagttaaagaaatcagctctcaatgattccattattttcaaaggtgacgataacaagtattatgagcagataggtggtaagatagttgatataacagatgaaatgccatttgaaatacccgacacatgggcatgggtaagaataggaatactttttgctcacaacaatggaaagcagcttaataaaagtaattcttctggtagatttatggagtatattactacgtctaatttgtattgggatggatttaagctggataacctcaaaaagatgccctttgaaaagaacgaaattgaacgttgccaagctatcaaaggcgatttgttagtttgtgaaggcggtgatgtgggtagaacatgtatttgggaatatgattttcctattatgcttcaaaatcatatacataaattgagggcttattatcctctttgtacaaaatacttttattatatcttctacctctacaataaaataggcattataggaggaaaaggtattggtattcaaggattttcagctaaagccttacacaatacacttgcaccacttccgccacttagtgaacagaaacgaatttgtagtcgaatatcggaattgtttggcaagattaaggcgtaatcaagccttaatcttgctgtatatttcattgattttgttcacaattcttatttgctcttgatgcggtggaatgccgataataagtgaatagaatatttccttgtttagatgtggaatggctgcgcctcgtttagactttcgcaataactccttgtagaacagaatatagtttaagacatacggcaaatgcataatagaactaacccagagttgcttaaatgtgctacccatatagccatcacaaggtacagtgaacacttcgccagaattttctccgtccacaaggatgatgttatcgcccttttgcacaaatctccccctttgcaagtaatcacctgcactctttccacgcagatattttgcatcaaggcaaatttgttgcccatctttcttctcgccgtcaacaagagtacaaatagaagataatctcgtaacagcccaattgttcggaaaatagtaatcgcattctatttgagctacttggccatttgtctgctcataatacttgctaatttctcaattttagatacaatacgatattgttctttaagaggcggtaaaggtattaaatgcgaaaccaatttttctctagatatattcggctgcgcaccaccttctccttttcttacaaaatcgtttttgctggcaattaagaaataaaatagatatttgttgtaaatgaatggagtacatccacaacaagcttgatttgtagtcatttctttacctgcaatagcgactttcccaatagttgcaccatacattgcaatgagaacatctccgggtttgtttagcttgaaagagcattttttcagagctttatctgttatcttgatttcggtatcatttacaactccattattaagttcacctgttcttaaccaaaggatgtttcctccgtagtaatcagaattttcctttgcaggagttgaaccagacccccaatctccaatattccccattctcgtataaacccaatttgacggtatgtcaaatggtatttcatcgtcaatgcaacgcacttcctttccaatcttctcccaatacttgttatcgtcacctttgaagatgctggaatcattgagggctgatttctttaacttgccttctttggcaagtttttgcttctcctgtcgtatctgttcaagcagttcttgggctgtaccttcttcaaatatttgaggaacaagtttaccttgtattgcttcctgtaaaatggactttttaaattgttccttaacttgttcattcaattggttaagaaagtcttggcttttcccatagcgttctatgaggaaagatacattgcgtaatttttctacaatttgttcttgttcatttatgggagggattggcaatagcattttggcaagtgttttcccattacagttaggttgtgctgttgctattgtaccattctttaactgttcccaatataattgactctccataaaagctttcatataataaggacagagcaaagagctataccttgttctaatcaaatatcctgcatatatcgctttcacaggtacatcttccactaaaaaggactttcccacagtaccacctgttctggcaaatagaatgtcatttactttcaaaagatatgtttctatttcacttgtattaatcaaacaaaatggtacattctcccataacactttgttattctgaatgtcacttatacgaaccatccttatatctccattttctaaggctggtgcattataaccatattgaatagattgagagatatttccccaacgttcccatgcccaactatttggaatttcaaacggaatctcctcatcgatacacttcacttccccggtaacaaggaacttctcataataggaactcaacgcatttggctttcagcctaatttattagagataactcattgtttcactaataaatttgaatatggaaattaaagattttgaggaatgtttgcgccagagcaatatggcagaaaacaccgttacagcatacgtgtatgctgtaaaagagttctattcccgatacaaggatttgaacaaaaagaacttgttgatttacaagacgtacctgattgagaagtataagcctaagacggtcaatctccgcatacaggcagttaataagtatcttgatatgtcggggaagtcacggttacgactaaagtctgtcaaggtacaacaacgctcttatttggagaatgtgattagcaatgccgactatacattcttgaaaaacaaattaaaaagggaagataaccttgcgtggtatttcgtggtacgttttcttgccgctacaggagcacgtatcagtgaacttatacagatgaaagtggaacacgtgatggtcggctatttcgacatttacaccaaaggcggtaagattcggcgtatctacattcccaaagtacttcgtatggaagctgtatcttggttacaaaaagaaaagcggacaacaggctatctgttccttaatcgcttcgggaatcgaattacggcaagaggtatagcccaacaactgaaaaattatgctcaaaaatacggattgaatgagaaagtggtttatccccattcgttccggcatcgtttcgccaagaatttccttgaaaagttcaatgacatatccttattggcggacttgatggggcatgagagcatagaaacaactcgcatttatttgcgccgtagcagttccgagcaacaggctatagtggacaaggtcattacttggtaaagttgtggtggcgtaatttatcaacaaagggatactgctgaaatatccctttgttgtagatagaatacttatcttctttgcttgattttctcctgcatcaggctgtcggaaacagccttcaagtttctgtcgtagccgtcagtctcctgctgtagccattcaatggtttcctcgttgcgatggatgtcgaacacatcgttcagccaaaggatatgactggcattgcatcctccccatgagcggatgacgcggaacttcaacgcatcgtcctcatattggcgcttggatttccatagctcaatgttgacccaaattgaaaggctgcatacgatgcccatgccgaccaaaagagaaagcaccttgttggacttgatgtcgaattgatgacggtggatatgctcctgcggctcggtgtcgcgttcttccgaacttagggcaaacgattccttcaaagcccgtaacaggtgtagaatcctattcgatgcgtaaacctccgcttcagcgaatttggtcagcatggcttttgtctgtgcctgatgctcccttgcggaactgtcaaacagctcctttatgggtgtcaagtccaccgccgtaggctgtccgccagattgattgttggttacttttggagcgttctctaactttccgttgatgctcttgaggtcattcttgatgtcctcaaagagcgagtaaacttcattattatccatgtttaaaatcttattttacgttgtttctttttcttgttcctgcgttttaattcttcctcgaaacggttttcctcagcctgtccgtccgcgttgtccggcatgaaaagaccaatcgaaccgctgtacaaatcatcgtttccccttgattcaggttgaaacgtgggcagttcttcatgacgcgaagagggtgacatttccattcgctcggtatgtctgttacgttccaatgcagcatctatcttggaatagctgaaccgcctgtcaatcttggaaccgctgaacgaatagccgttcatggtgaaaactataccctgcacctcgtccgacttgcccttgtacttgaactgaatttccacgccttgtttcttcagattagcggcaagaatgttccagtttccacaccttgaaacctccgatttaaggatggagtaaagcccgtacttggtcttgtccggctctttcaagcggtgctgcttcacccgttccttgccgttggcaaaatacaggttatatttcttcgtcagttccttacagatgcgtgtgctacgtattcgctcgttgcggtcgctgattgtcctgccattattggcgatacggttgaacgctatatgcacgtgcggatgctccttgtcgaagtggcgcacgatgagaacctgcgtgtcggttatccccattttcttcaggtattccaacgctatttctgccattgcgcggtcggtcaggcggtgttcgtcctccttggagaaagccaacgaaatgtgtccgacaggcttcgtaacctctggattcatctttgattgtacctcgaagctcatggctatcgtgtccttgttctcggcaaacagaccgtcacagacaaggattttagcgtcctttcccttgtcaagaatgtagctgaccacacccctgaaactgcttccctttacgattttagctatcatatccggctgttataagaggattaaattcagcacttcttcaatccgtgccacgagtatgtggcactccatcctcaccatgacgaagcctgcggcgttcgccttgtgtgcaagctggttcaggttgttcgccatgccgcagagttggcggacgtaaccagtatgttccggcgtgagccgctccttcacttgcccctccctcatgcagcggcgcaggaactccccggcggatatgcccgcgctccgtgccttgcctttcagcgtatagtagtccgatgtcgccatctttaccgtgaggcggtatttcagcttatctgccgctcccttcttggggcgacctcccttgtttcttcttactgttttttgcttatgctccatacgtttattactgtttataatacagatacccattagaccaacgggatgcaactctccacggagttcatgagtgggagcaggcggtttcggtatgcccgaaacacaaacttgctcccctcaaaactccgttggactggttcagggtaactctgaatcgctcccgtcaatccgcctcttaattctcagagtttacgccatgcctcgatgtcttctccgtaggtgtcaaggtgctgccgcgcgatgttctccaccagtcccgacacgctcatacgtcgctcaccgaacatgcggacaatgcggtcgagggcatcgcgcgtgcggcggctgaggaatacgggcttgcggtcttcaatggacggaacagggaggaaggcttccttgtactcatccaacgatgcccgtcgctgcttgccgctgatgcggcgtaccacctgtggagttccatccgcttgttccggcacggcttcacttaacttttcctgtacaacctcgcttgccttttccggctgttcctttgtgtcggcaggctgtgtgtcgggcttagggatttccatactcggcttgctacctaaaaaatcctgcaatgctgcatccatactttggctgcttaaatttttcttcatacttgtttgaatttagtgtttaacaatgttggtcgttgtgcgcacatttgaccgattatcagttgcaaaggaaatggctgtattgcaggctgtcaaacgaatgggtggactgtggcaacaatgtttggttttgcactttatgcattgtcggaacggtgtgtgctgcatcgttttgccattgtgcgagaaatggcattaggatttttaagggcttaattggaatggttggaacagatttaaggacatggcttggcgtgaaacagatgaagctcctttcaagaagtataggaatccgaagaacgccataggctaccacaccgacgccaaatgctgccacgcctttacgaagtggttggattgtgccggacttcgcttttctttgcatcatggacgcttgaaacagccgtcacgggttcgacggataacgccactcccgaccacttgctgccacaagctgccacctcattgcaaatccattgtttcaagcggacaacggctttactttgcaggcaaaaagaagaacaattagtaaatataatgagcatggaagtagtaatcatttcaaaaagcaagtatgaggaaatggtcggcaagctcaaccgcctgtccgaccgggtgaatgaaatcctttgcaagagggaggggaaacggctcagccgctggatggacaaccaagaagtctgccaacagttgcgcatcagtccgcgtaccttgcagacgctccgcgataacggaacactggcttactcgcaaatcggacataagattttctacaagccggaggatgtgcagcgcatcgtccggctcgtggaggacaggcgtaaggatgcagcctatcgtggctgtagcatctaatcagacaacataatgtacaaccactaaatccactgtaaattatgaacgacttgattcttgccgaccgtgaactggaggtcggcttcatcggaaaactggatgccttgtttgaaggcatcgaaagaatggacgcggagcacaaggcttcgccaagtaacgaacaattcctgacggacaaggaggtgtcggcatggctcaaagtgagccgacgcaccttgcaggactaccgcaacaacgggatgatttcctattaccagttgggcggcaagattctgtacaaggaatcggacatcgaaaagatggtgatgagcggctatcggaacgcataccgcttgggtacgtgattagacacatgcaaaaacagagaaagccgatggtcgggcagttctcctgccgccatcggctttctctatacaagaaggtcgtttcgcgtcattctaacacgtacatcgtggatgggtaccggatagcgaaaagaacaaatttacaggtttttcacggtttgctatgcatagcctttccatgatgaaccgtctgaaaaccatgctctcccgacttctcaacttgaaggaaacggcaatcaccatttcaaggctgtaaacatcgtagtttatcccgttgtcctgcctgacatgtcgcatcgtttcttcttctaaaactccatgtttttgtagatggcgtgtacagccttacgaatgtgacagccgaacacattgaacgcatcggacatttcctgctgcgtcatccaaacgggagcggtcggcatagtgaccaccccgttttcagtgattgtaatgattcccctgtccatagctcttaccttacattagaaagtacatttcgtacattggtcatatcacgcagaatggaactatccagcacacgcgcatagtgctgtgtcatttttatattggagtgaccgagcatctttgccacgttctcaatactcacaccattggcgaggcagaccgaggtcgcatacgagtgccgcgcaacatgagtggttaagttcttctttatcagacacaaatcggctatctctttcaaatagctgttcatcttctggttgcaggggacagggagcaatacctttttcttttggcatatcggatggtcggcatacttacggagaatttccaaaggaatgtcaagcaaagggatgttgcacatattcttcgtcttttgccgtggcttgcgaatccatagattgccgtttgcatcttctacaacatgttcgggtgccagttgctgcacgtcaatgaacgccaaccccgtcattgctgcaaagatgaagacatcacgcacgattcggatgcgctccaatggaaagtctttatggtagatggtgagcagttcatccattgtcaggaactcgcggataacctctttctcatggaacttgataccgacaaacgggtctttggttatccattcgtttgccaaagcgagattggttatctttttcaggcacttcatgtaacggataacggtattctgttggcaggatttttccgttttgaggtagaactcaaaggcacgaaccaactccccattgacttccgtcaacggcaaatcctctttcccatacttctgtctgataagctctgcgagatagcgtttgcagctttcataacggcggacggtaatcaacgcgtagtctttccccacgagggcgcggcattggtcattatgttcctgtatggtgttgatgagcgtgcagacttcttccagctccttgtcttgtccgaaaaacttttcctgcaacagacgggcggtgatgggctgtcgttgttcctccagttcattaaaaatttggtggagcttgatttttgcattttcgatataggcgttcaggtcgcacgccttgcggcttttcccacgggcacactccttcgcctgattccatgacgcagggtcgatgctcttgcggatgttggtttccactcgcgcaccgttcacggtgatgcgcatacacacggaggcttctccgtttttcagcagtttggctttcttgatgaagaaaagcacattgaacgagtttcttttcattttcctacaatttttagttggacaaaagtaggaaaccatccgcgttttattgatacgcaaaacattgcaaatcaacgaataagaatccggttcggtggagaatttcgctccaccttttccgctccaccttttggaacaccgaaagcggtcatattccgcacttttttgcgtcctgcgggaaaacaaaaactcccgatttcgtttggaaatcaggagtttactgctatttgcttttcttcaaagtggtgccaccaggaatcgaaccggggacacaaggattttcagtcctttgctctaccatctgagctatggcaccaacatgtaattgcaaaaggttttccttatttgcggttgcaaaggtaaactaaattttcggagtatacaaatatttggtgaaataaatgataaaaaatattttatgtaaatttttcctctatttgtttggccgtttctcagaatatgcatatctttgcaccgcaaatcagaaatgactgcaatcggaatgtagcgcagttggtagcgcactacgttcgggacgtaggggtcgggcgttcgagtcgcctcattccgacagaaaaaggtttaactcttctctctgagttaaaccttttttattttatatcgatatcatatcgggtgttaagggctcaatgtaaaaccctgagggattcgttgattaagcataaattttagttggtttgaacaaggtaaatttggattaacgtagaaagtcgggaaagagcgatatgtgggttggtggaagattttacgtgtgatgcccgaaaaacaaaaaatcccgattcaaaaagaatcagggtttaaagtggtgccaccaggaatcgtaatctaacgataagtggctgaatatctttgatgtatcttttagctaaagaagtaatctcccgctattgctccaccggattcttgcaatattttgcagtgtcttgcggagtcgatttcctattactctacaaaggtaactctttattttgaaatacaagcagatgcctcatgtttttgctccacctcggtgtggaaacttaattcgaatattgatgtgtacaaaattttatattcttctatacttcatagcatatctatctgattgagtatctatatacatttggtattcttttattcctttttcctttgctatatcgcttattattttcttatttatcgcagacatatcattgccgtaataaacagcaattggttttatttggatgtttaaactggataatcctatagaattatttttatttagaaacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgttagaaataaacgccatcctttttcatattgccattgaggtgacttgtaaagagcagccttggtataatacattgtatcattcattttggcatttagccccaatgataaacctaaataatattcgacaaacgatgttgcattatatcttctattgtcatatattataggataaatattataaaagtatttgcaaccagttattactcaatattttgtgagttataagtcagaaatatgggcataacctttaggggtacattctaaaaggtgaagatttaacctttttattatttcttaacactcaaagagcggtggtagagggtattttccctcttttcggtactttattgatggttcgatgttcccatctttccacattgcttggctcgttcgcacaagccactacaaaggtactacaatttccaataaaggcaagaggacagcaattcaaatctattatttttgagggagtgaaatctgccgcttgccaaatttctctctgtcgaaaataatagtcctctgaaaagaatgaaaacagcattgataaaattgccttattaaggggggctatgctgttttatgctattatttcgtcagtcgtttatctccgttgccggatgcagttttcagccaagccgatgaataagaaaaggttttggagctgtttactctccaacggaggacgaaactgctccaaatggtttaccgcttgaacttttcgttttctaaaagaggtttggcaacctttgcatccgacaaaaggagataaatgaccagatatataacagtagtattacattaaggtaaagaacaaccatggtatagtattattgcaatttaactatttaaagtttgtttataatcaaatcatttaaagatttttgtccttctatgattttttgtatttgataaatgtccaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgaaatgtcgtaattaaataaaaaatatcacgcataatgactttttcttttttctaaatttcttcaaatgacaaattattgttacctttgtaatgtaatgtagttaatggttgcgcttataaagtccttggaaaggatttatgtataaaagaggtagatgtttactctgttcttgcctggattatcagcatcactgatatgaaataacagaaaaaatatacaatggctaagcggacggacaggcagggaaatagtacagattcccaatccccctctttataatacattgcgtataagatttattaactgtctggggaatctacagagatttaacgaatcaagatgggaagagtcggtctttgtcttgtcataatgttcttcatctgtagtgctcaaaaaattgatgcacaagtacagaatatcagagagaaacaagataccatttcggcgactaaatcattagagcatatcaggcccgagaatatcaagaagggaccattgaataatgctttggatgtattgagtggtcagtctgccggtgtgaacgtcaccactaatgggactgacaggctcgctatgctgaatagtatccgtgtgcgtggtaccacatccattatgggtggcaatgacccgttagtaattattgacggagtgacatctgacatcgctacgctatctaccatatatcccgcagacatcgagagtttcactattttgaagaatgctaccgaaacggcaatgtacggttcccgtggtgcttcaggtgtaattgagattaagaccaagaaaggaacggggcgaggtttcgaaatatcatatgatggcaactacggattcgagtcaatgtataaacatctgcaaatgctcaacggcccggagtatatagctacagcagaggcacttggattagattacaataatggtggctacaacaccaattttcacgatgtaattactcgtacgggcttgatacatcagcatcacttggcttttagcggtggttcggaaaactcaaactatcgagcatcgttcggttttatggatcataatacaattgtcaaagttaacgattaccgaaatttagtggtaaaacttgatgctacacaaaaggctttcgatggtcgcttagttggcgattttggtgtatatggctactcgtcaaagatacacgacattttcgatacacgaatgctgttttactcggcagctgcacagaatcctacatatccagcaggaactgatgttaatggcaactgggtgaagaactcggctgcatcacacatcaaccaccccggagcactcctctatgagaaaaatgactccgaagaacggaatttcaatacacatttggggctgaaatttaatatccttgacaatttgatattgtcggctttcggctcttattcatattcatctacgggaaatgctcaattttgtcctacatgggtgtgggcgcaaggcaatgtttatcgtggagagttcaagggtgaagactactttacaaatgtgtccctctcatataacaatgcttggggagactcacaccttgatgctgttgttggcgcagaatatcttaaacaggtaaggactggtttatgggtgcaggcaaaaggaataacaacaaatgatttttcctataataacatcggagcaacatcatcgcgtcctttcggtggtacgagcagtagctatgaagacccgtcacttgcttcaataatgggtagtgtcacatatagttacaaggatagatattctattgcggcagcactccgtggagatggctcttcaatggtaagcgataacaatactttcggattcttcccatcagtatcactgggttgggatgtaaaaaaagaaggcttcctctctgatactgactttataacaatattgaaactaagaaccggatatggtcggtcaggaaatcttggaggtataacatcctatacaacacttaataccgtaaaggagaatggtatcgtatccatcaacggtgcacctaccgtaacaatgggaagtatacgcaacacgaatccggaccttaagtgggagactcgttcaacatttaatatcggttttgacttaggtatatgggataatcggttgatgcttacctcggaattatattactcaaagacaacggatatgctctatgagtatgatgttcccgttccgacctttgcgttcgataaactgatggcaaatatcggctcgatgtctaaccagggtgtcgaactaggaatctcggtagttcccattcaacgaaaggatatggagatgaatatcaacttcaatatgtcctaccagaagaataagttactttcgcttagtggagagtataatggtatgcatatgacagcttcagatattactccgattggctcgctttatggtgcaggtcagaacggtggagacaataatgtagtatatcagattgtaggtcagccattgggggtattctatctacctcactgcaaagggcttaaagaaaatgaacttggtggctacagttacgatattgaagatttgaatgatgatggcgagattgattttagcgatggcggagacaggtatatagcaggtcaggcaacccccaaggtaactattggatcaaacatcagtttccgttacaagtcctttgatattgccatgcagataaatggtgctttcggtcataagatattcaatggcacgggcttggcttataccaatatgtctatattccctgactacaatgtattgaagggtgctcctgaaaaaaatattattgatcagaatgtttcagactattggttggaaaaaggtgactatgtaaatattgaacatattaccataggctacaatattccaatgaaatccaaggctgtgaagtcattgcgtctttcggcaggcattagcaaccttgcaacaatcacaggctatagcggtcttactccaatgataaacagttatgtagtaagcaacactttgggcattgacgacaaacgcacctatcctttatatcgtacctattcgttaggtcttagtattcaattataaccgcttacagttatgaaaagatatataaacatattgatggttgctttggcaacgatgatgacctcttgtcttactgaagaccctagagatcaactttatgaagaagacatttacaacaatgccaacaacatatatattaatgcagtggctgtgctctacaattacattggtggcagtgcagacagtgagggtttacaggggacctgtcgtgggatttatgactataacacacttactacagacgaagccatgatacctattcgtggtggcgactggtacgatggaggtttgtgggcgaatatgtatcagcataagtggagtcctaatgatttaccactctacaatacttggaaatatctctacaaggttgttgtgttatcgaacaaatctctgcatatcatcgataagtatagccataacctatctgaggagcagagagtggcctacgaagctgaggtgcgagctctgagagcacttttctactactacattatggatatgtatggcagagtgcccatcgtaacatcctatgaacaaccgcaggatgaagttgtgcagagcgagcgtagcgaggttttccgttttatcgtgaatgagttgcaggaggttgccgagttgttgccaaatgagcgtagtaataagatgggtaactactatggtcgtataacaacacctgtagctaatttccttttggctaagttggctcttaatgccgagatatattgtgatgataattggactgatggcgttccacggaacggtaaagagatatttttcaccgtcgatggtgagaaactcaacgcttggcagacctgtatcaaatattgcaataaacttgccgaggtaggttatcggttggaagacgattatagctataatttctctgtgcataacgagaactccaacgaaaacatattcaccattccgttggataagaacctctatgctgcgcagttctggtatctcttccgatcacgacactacaaccatggcggtgcgttgggtggctcatcggaaaatggtaccagtgccaatatctcaacagtcttagccaacggatacggcacagatgatgtagatgctcgctttgaaaagaacttctatgccggcatcgtagaggttgatggaaagcctgtaatgatggacaatggacagcagttggagtatttcccattggagctaaagttgaatcttacgggaagctcctatgtcaagacagctggtgctcgtatggcaaaatatgaggttgataggacctcacattccgacggtagacaaccggataacgacatcgtgctattccgctatgccgatgctctcctgatgaagtccgaggcaaaggtacgtaatggtgaggatggctcgttggagttgaacgaagtccgaggtcgtgttggtatgccatatcgagaagctacgcttgagaacatattgaaagagcgtttgttggagttagtatgggaaggctggcgacgacaagatatggtgcgttttggagtttatcacaaatcatacgatcagcgagtccaactggctgatgagaaaaatgggtataccacagtttttcctattccacaaaaaagtatagacttgaacccaaaattgaaacaaaatgttggatataaataactttagcctatgagtattcaatttgacattgcaaaacagattatagctgaaacatgccctaatcgcaaacttaagttggagaatattcgcctttttgcagatattattcagcctaagaaatatcaaaaaggtgatataattctaaatgaaggtgatatctgtaattgcctattttatatagaaaagggatttattagacagcactacctaaagcatgataaggatgtgatagaacatttagcatgtgaaaaagatgttgtctggtgtattgacagctattttaaccgagagccaacacatcttatgatggatgctgtagaaaacagtgttttataggaaattccgcgtgatataatggaagaactttctgatgctaatggtgatatagcttatctatatcggagtttttttgaaaattccttaatgttatcacaattaaaggctgacattttacgtttcgaatcagcaaatgacagatacgctagattacagcaacattttcctgaaataactagaagagcacctttgacaatgattgcttcatatcttcagatgacattggaaacattaagcagagtacgtgcatcaatagctaatgctgagagcaaataaagcaaactaactattaggacttaacttataagtcactttgtgctctttgcagtagttcattatctctactacttcttctcgtgtcatcataactttgctttttggacgtaaagttaatgatggaagttggagacaaaaatacgtggtttaccgaatgcttacgtctttttccatactttaccatcttattttacgttgttttttctttttcttctttctcaaataatcgttcggataaccttctggttgttccggttgtgggttcggtgtgaacagacctaaagaaccgctgtataattcatagccatgcggttcctgttgccatgttggttcactctgaaccaacacctgtctatgggtttccgaatgtgacggtgtctttaacgcggcatctattttggaatagctgaactgcctgtcaattttggaaccgctgaaggaatagccgttcatgatgaacacgataccctgtacttcatccgaatttcccttgtatttgaaccgtacattcactcccttttcgcttaatccggcaatcagctccttccagtttccggcttttctgacttccgttttaagcagactgtaaagttcatattttgtcttgtccggttctcttaagcgttcagtcttgacatgatccttacctttagccatgtgcagaccatatttcaaggtcagttccttacagatgcgtgcactccgtaaccgctcgtttttgtcggatatggtcctgccgtcattatctatccggttgtaggcaatatgtatatgaggatgctccttgtcgaaatgtctggctataaagaactgcgtgttccttatgcccatccgtcccatgtattccaacgctatttctgccataatccggctggtcagcctgctttcatcctctttggaaaatcccagtgcaatgtgtccgaccggtctggatactttcggattcattccggcttgtgcttcgaaagcctttgttattgtgtcaacatcctcaatgaacaagccggcatgtgcgataatcctggcatcctttttactgtcaatgatataaccggtaacctcacggaatccgcttccctttacaatcttcgcaatcatagcaggatatggttcagcagttcttcgattcttgccacctgtacacggcattccagctttgccgtatcgaatcctccggcatttgctttatgagccagctggttcagattgttcgccataccgcatagcttacggatatagtcggaatgttccactgtaagtctttgccgtacatatcctttacggaaacattccctcaggtattcgcttgccgatatgcctgcgcttcttgccctgcttttcaacgtgtagtaatccggtgtcgccagtttcacggtaacacggtatttcagtttgtcggtcgtactcttgggaggacggccgcccttgttgtttctttctgtattctttttcttttccatctgttgactattgtataaaatgaatgtactgattagaccagcgagatgaacctctcactgcctcttgtagtgggagcaagcggtttcggtctgcccgaaacacaaacttgctccactaaaaattagagtcccgctattttgagcgtctctgaatatgctccctataaattggggagaaataataccgttgtcggtatcatcttatggaggggacagacctgtttttccgtttctgttcatcatgtattttctcattttgtttattatatcccgatatatctcggaatgaattgtctggcaaaaaaagaatataagtttccaatagtcaaacagttggtcgggatgtggcaacaatgtaccctgttgcagtttgcatgcagggcaatcggtgtggaatgcggtatttttcctgtttgatgaaacaatgaaccggggattcaaacagttactgatctattgacttgaatatttactgacttaatgtcgtattgtcgtactgtagtaaatattcatgtctgtgaatcattgaaggaacacttctttgcttccttatctaatcaatggtttggaaaaatgatgaagtaaggttacatggaaataaaccattccttatccattgctatggacctttattgaatcaggttcatagatattttattctgtaattcattatcggatggagtccctgaatatagggatatttgcaaaaaatgatatgaatgtggcctcataactaggataatcagcgccacatgctgccagttaggcggaaaccattgcctttcagaatatatggcttttctttgtcgcaaacaacgaaaaaagaataaacatcaatcaacaaaaaaggaaacgatatggaatttgtaggaatagaaaagcaactatttgaagaattggtgcgtaagtttgaatactttgagcatcgggtcatggaaatttgcaaccgggagaacgacaggaccctgcacaagtggatggataatcaggacgtgtgccggtatctgaacatctctccccgcaccttgcagacactccgtgataacggtaccctgcctttttctcaaatcaatcacaagatattctataagccggaagatgtgcagggtatcgtcaagaaagttgaggacagaagaaaagaggctatttacagaggacgtaacatataacagttaaacaataaccactaaatccataataacatgagtgaactgagaacagacagcagagaatgggtacaccgtatcatgggaagtcttgaccgtatgctggtcgggattgagaatctggcggtcggaaaccgtcccgtactgggcggtgaacgctatctgaccgacaaagaagtgtcggcacaattgaaattgagcagacgcacgcttcaggattatcgtaatgaagggagaatatcctattatcagttgggaggtaaaatcctttatcgggagagtgatattgagaaaatgcttcaggaaaattatcgggaagcatatatgagtggtaaataaaagaaaggaataaaggctgtgtgccggtctggatgaaccgatgtcacacagcctttatgcttttatgatgaacaattatacatcttccggcatggggatgacaaggatagagtcactgcaccggattccgtagaatacgtcacgaacccgcccctgctgaggtatcagaatacccttttctaccagatcttttatatcacgtgctgctgtatccggtgatacctttacacgttttgcccagttcttagccgtcagtttgccgggataaccgtccaaatataaattcaagacttcacgttgtcgttcggacaggactgtttcggcatgggtttgccagaatatggccttgttaagaaccttcgacaatgtttcgtcggattgctcgacggaacggatcagacagtcaagataccagataatccattcagtaatttcacaatctcccttctgcgttttctccaatatgtcgtaatactgttttttatctttgtttatctgatgggagatactgaagaaacgcatctttgagttttcggcctgtgaaagtgccatatcagcaatggctcgtccgattcgtccgtttccgtcatcgaaaggatggatgcagacaaaccacaaatgggctattgccgattttacataaccgttatgtgcatctgaattgaaccagtccagaaaccgattcatttcttcgtctattctttcaggagcaggtgctacataatgtaccttttcccggccgaacattccagaaataactttcatatctccactgcggtatcgggctacatctattttcgttggaccgctccatccggtaggaaacaggcagttgtgccagccaaagagtctttcatgggtaagcggactgttgaaattgacggttgcgtcaagtgccatttccactactccgtctatatatcgtgaggattcggtcggattcggtagttgtactccaagtttgcgggctacagatgaacgtacctgttcattgttcaattccactccttcaatttctgatgatgcaatgatgtcatgagagatggattcaactacggcagacatcttgtcgttaaaaccgattacactaaggcgtcccatcagataaccgacagctttgtttaccttgttcagcttctcaccgacaagttccttgttccacgaaaaagaaggccattctttatgttcatgtatatacataggcatcactgttttctgcaaatatacggttttgcggataattaaccgcaaattttgcggcttattatccgcatgaaatagtgaaatcaatatttatcagcattttagatatgacttatgattaccattcatcatgcagataatcattgacttttcagattgaaacagtctgcttattatatactcacgtaattgttgggccggataagtattaatctgaaaggcaagcgcaaatatcatttccaggttatagactatctgatacccctcttttaacggaatacgttgttctgcggtgaatggttgcaatatcccaagtttatatattctttttttcgcagcccttaaagtcggtgcaactacattgaacaagccgacaagttcggcttcgtccatacgaatcttatcaggatggacagcaggaataacaatcctgccgtcctccattatatggataatgtctcttttcataggctataggcaatttgaaagtatatcccttacattattcatatctttcagaatggaactgtcgagtacccttgcatagtgttgcgtcatcttgatattggagtgaccaagcattttggctacattctcaatgcttaccccattggccaaacagacagatgtggcgtacgagtggcgggcggtgtgtgtagtcaggttcttctttatcagacacaggtcggcaatctctttcaggtaactgttcatcttctgattgcagggaacaggcagtaatactcctttctttttgcaggcaggataatctgcatattttctcaggatttccaaaggaatatccagtagcggaatgttacacatgttctttgttttctgacgtggcttcctgatccacaggtttccgttattgtcttttacgatatgctcaggggaaagctgttgtacgtcaatgaaagccagaccggtaaaggcagcgaaaataaaaacatcacgaactacggtgattcgctccagagaaaattccttgtgatagatagtcagtagctcatccatagtaagaaactcacggattacttctttttcgtggaacttgataccgataaacgggtctttggctatccattcattggccagtgccagattagtaatcttcttcaaacatttcatataacggatgacggtattttgctgacattccttttcagtcttcaaataaaattcaaaagcacgtaccagttcaccgttgacttccgccagcggcagatcatcctttccgtatttctgcctgataagttcggcaagatagcgtttgcagctttcgtaacggcgaacggtaatcagggcgtagtctttaccgaccagggcacggcattggtcattgtgttcctgcatggtgccgatgagggtgcggaccacttccggttctttgtcctgcccgaaaaatatttcctgtaacagacgtgccgttataggctggttctgttcttccagttcacaaaaaatctgatgtaatttgattctcgcattttcgatataggcattcagatcgcatgatttgcggcttttgcctcgggcggattcctttgcctgactccagagagacgggtcaatgcttttgcggatgttgttttcaactcgcgtaccatctacagtgatacgcatacaaacggatgcttctccgtttttcagcagcttggtcttcttcaagaagaaaagcacattgaatgaacttcttttcattttcctacagtttttagtttggacaaaagtaggaaaccgaccacgttttcttgatacgcaaaacattgcaaatcagtgagaaagactctaattcggtggagatttttgctccaccttttatctccaccttttgctccacctcaaacggtcatattttgccgttttttgcgtgtcgggagaaaacaaaaaatcccgatttcgcttggaaatcaggattttactgtcttttgcttttcttcaaagtggtgccaccaggaatcgaaccggggacacaaggattttcagtcctttgctctaccatctgagctatggcaccaacatgtctttgcaaggagtttttctcgtttgcggttgcaaaggtaggcaaagtttttgaaactacaaattatttcttcgaaaaatgtcaaagaaatgctactttgattgaatcttttatgaaaaatgaagggatataaggctaagatagattactatagaagcagatacaaggagaaggggatgagaaaaatacgaggtttcagaccaagatgaggcattatagaaagtcgcagattataataatctgataaaaaaggagggtgagtaatgtcctattatagagtaaggattcggggacgaagctccttcgaataaacgcttgagcttgtgagtaatctcctattatagtaaggatggacattctctcggtagatgaggtcgattttgtatacggcggacaatctccaattttagtaaggatgaacacttcatttggaatttaaacatgcttaaattccaaagaaaaagtcgcatcacattccaattaaagtgatccccaaaagttagacagaaaacttttggggtgcacttcaagtttgatacgacttttctggttttattattctaatccgttactttttgttgtaatcatttagagcgatgatgtaactcttttgttggattattctgctttcagcgggttccatccttgagctttcagctccagttcgttgccgtcgcgagtaaccaacgcacagcccagttcgggttttgtgatatggccgatgaacttcacccctggtatttgtgaaactctttcgtgatcggtcagggggacggtaaacagaagttcgtagtcttcaccaccattcagcgcgcaagttgtcagattcatgttgaactcttctgccatgaccgctgtctggtagtcgataggaatacggtcttcgtatacccggcaaccggtcttgctctgcgaacagatatgcatcagttccgaagaaaggccgtcggaaatatccatcatggccgtaggacggatgccagcttttgccagttcttcgatgatgtcgcggcgagcttccggttttaagaagcgctccagcagatattctttgccagcaaaatcgggttgcacatctttttcaccctgaaagactgctttctcacgttccatcagctgaagtcccatataagcagcccccaagtcaccacttacacaaatcaggtcggtatctttggctccgttacggtagaccaccttatccttgtcggcttcaccgatacaagtgatagaaatagccagacccgttaccgaagaggttgtatcgccacccacgatatctacatgatgcagctggcaagccagtttcaccccgtcgtaaaaatcttccagatcttcgatacagaaacgtttggataccgccagcgatacggtaatttgtttaggagtaccgttcatggcatagatatccgagaaattcaccatggccgatttatatcccaaatgcttcaggggagtataaaccagatcgaagtgtacaccttccatcagcaggtcggttgtgaccagcacctgctttccggcaaagtcgagcacggcagcatcgtcgcctacgccgtacttgctttcctcattctgtaatttaatatcctcggtgagatgcttgatcagtccgaactcaccgagagttgatatttcagttctatttccttcgtgcataattttttacgctctgttaataagttctctcatgatggtcgtcatgcgtggctgtgcctcgtcggcagccttctgtacctcttcgtgtgaaacctcgacaatcttgccttccacgcccaggtcggtaatgactgatacaccgaataccttgatgccgcaatgattggctacgatcacttcgggcacggtggacatacctactgcgtcggctcctaaaatacggaacatcttatattccgacggagtttcgaaagtcggtccctgtgtgccgatgtatacaccctgctgtaccttaatgcccttttctttcgcaatttcgagtgcttttgcaatcagctctttcgagtaagcttcactcatatccgggaagcgaggtccgtattcaatgttctttccacgcagcggatgttcggggaagaagttgatatgatcggtaataatcatcaagtcgccgatttcgaaattagggttcgtacctcccgcagcattcgatacgaacaaagtcttgatacccagttcacgcatgacacgtacagggaaagttacttccttcatcgaatagccttcgtaaaagtggaaacgtccctgcatggccataatatccttgttgcccagcttgccgaaaatcagcttgccgctgtgaccttctactgtagatactgggaagttaggaatttcggaatagtttatttcatatttatcggtaatttcgtgtaccaaactgcccagacctgtgcctaaaatgatggctgtttcgggatgagtgtgcattttagcttttagaaaagctgctgtttcttgaattttttctaacatactcgataatattttggttaaataaatgttcctcttcgttcaaaaaggctacctctaccggcagcacatagatggaaggcttcagcgtttcgtccagtagcggatgagtgataagccttgccgcatccttttcggtagtgacgataaagcgtctgcctgcgggcagtttcttgaaagcctccgttattcgtttcatatccgtcgcatcaaagtcgtgatggtcggggaaagtcaaaggcgtaatgaactgcgtgtaagccgacagcttgtcgatgatggctgcgggcgaggcgatgcctgtgaccagcaggatatgttcattcttccggatttcctctaaccttttttccggttctgccgtaaagagaggttgcagtttaccatacgccagcgtagtaaaataaagctgctgggagggcaggggagcaatctcacttcgtaaagcctgctgttccgcttcactcagttgtgccggacacttgctcacgatgatgatgtcggcacgcttcttgccactttccggttcccgaagtcgtcctgccggcaacatccggtcgaggtgaatcgggcggttgtagtctatcagcaggattgtcagtcccggcttcacgtagcgatgttggaaagcatcgtccagcacgatgacccgtactccgggagccgtatgaccgtccgtcagctggtgaatgccgtgacagcggtcgcggtctacagccacgtaaatatccggaaatttatgtgccatctggtaaggctcatcgcctatctgttcggcagtcgtttcgggagtcgccagcacaaagccttctgatttccgtttgtatccacggcttaaaaccgccacttgatagtctttccgcaacagccggataaggtattccgtatgaggagtctttccggttccacccacactgatattgcctacacagatgacaggtagcggaaaagactgtgaacgaagaatacctctatcgaacatccagttgcgtacgcttactcccagacggtaaagatacgcaagtggcagcagtccgtagtaaatctttatcttccttttgggtttcatcgggcaaccggtgctttatttgataaccacctcaaacggcatacgagcctgcaagcggtcggcatccttgaggttcttcaagaagcgcagcccgttgtagtattcgccaaagctgctctgcatgcgactgttgatgtaacggcttggacgagtgttcagcagagaagtcaggaagtcttcttttcccggatagcttaccacggtatagcggtctatcttcgcgcgtgaaaccgctgcttctacagcctgatccagtccgcccagttcgtcgactagcttcaagtctttagccatttctccggtccatacacgtccttcggctattttctttatatcctcaatatccattttacgtccgtcggcacaacgtttcgtaaagagttcatatcctttgttgaccatgttctgcatcaacgtcctttcctcctcgttgaacggacgggttaaattacccaagtctgccaattcgttggttttaacaacatcaaaattcagtcctaacttgtctttcagtaatccttcggcattgggcaccaaaccgaagattccgatagaacctgtcagcgttgtcggctcggccacaatccagtcggcggcgcaggagatatagtaaccacccgaagctgcatagtcgcccatggagactacaaccggtttttcctctttcagcagggaaacttcacgccagatctgttcggaaccgtaagcacttccacccggtgagttcacgcgcaggacaacagccttcacgctttcgtcctcacgcagcttgcgcaaatcttttatcaccttttcggaattgatcccttctccgtccttcgattcacctccgtctatttcaccataagcatagtacacggcaactacgttaccgcttttatcttttggtacatttcgttttacatttatcatgtcttccagcgaaagcgtattcagcttgtcatcttccttgcaatcagtcagttgtttcagataggccagtacctcgtctttatacatcagtgtatctgccagaccggtactgatataaagctctgcgggctggaagtccatgttgcggctggcaagagcattcagagaatcgaccgaaatctttctggattcggaaacatcgttcagaatctgttgccagatagaaccgatgaaagcctgtgtctgttcgcggtttgccggactcatttccgtagcaatgtaaggttctacagccgatttgtatgtgcctacacggaaaacctgcatttccacgcccaccttgtcgagcagacctttcaggaacatggtctgtgcagccagaccatgccagccgatgcttcccgaaggattggctataaccttgtcggcaacactggcaatgtagtaagtaccttgtgaatagcttccggcataagccacgataaacttgccgctttccttaaaatccaccagtgcgtttcttatcgcctgcatagaggctgtctggcagtcaaaagcacccgcatcaatgtagattccctttatcttgtcgtttccctttgctttacggatggaagccaggatgtcgtccagtccatagcttgtataatcttctcccaagaactgcataagcggattatcctgataacgttctacgacactgcctttcagttcgagaacaaataccgaacggtcttttactacggtttccgttccggaagaagaagcaactattccggcaagactgatgattcccagaattgtaaagactactcccgtcaggatcagaccgcagacggtagcaaaggtgtatttcagaaattctttcattgtgtgatgctttttagaaatttatcaaataacaaagttagtctttttcatggaataaccaaaagcaaacgatttttttcctgacgctgggagaaggagttgaaggatattaggcaggatgtgggcatgtgtgaaataagcttcagcatgtttagagaaaaacgtctcgatgtttttttattttttgtacaaaaaccaaaaaagtttgtacaaaaaatagtggagattttacggtcttttctttttatgccagcaagtcttttaaggaatgtcggcaattatgtatattgttgctttagtctcttgttattaaattgcttatttgtgaagaaaaaataatataccgcgatgacggataagaaattagtaacgaagttagtgaagaagttgtgactgattttattattttcaatctgaatcagttcagggcatttgccagaaagaaatgccctgaacagatggattgtcattcggttttaatgttgtttaccggattctctcgcacagctttccggctgatcaagaataccgaacccagtgagataagggtgatgacggcaaaagctgttggcggaacccaccaagggaagctactgtcgtaggctacaatcttgtcgatggtgtgtatgccgaatatcataagtggtacggctattatcaggctgatgagcaacgatgagaatgagaatttcatcagttgcagcatttcgttgcggctgctggagccgaaggtcttgcgaatggcaatatcacgcttgcgctgagcgatgaaatagatactcatggcagtcagtcctaacaatgagatgaccagtgcggcacaagtaaaaatgccaatcagtttgttcatgctgatgatatcgctgtactgttcgacaatttggtctttgtaccagcttgaatcgaacggtgcacctttggtgatggtactatataactcgttgatttgcttgccataggcagccggatttccgtcttgtacttccaccagaatagtccacggataaattttgtcggcggggagtatttgcagccgtaaggggtgctgctcactcatgaccgaacgtatgtgaaaatctctgaacaatccagcaatagagaaactacgtccccgctcgtcgcttacatagtcggttgcacctccgaggtctttggaggccgattcactgataaaccagttgttcttgtcgaatgacattttgtggtcttcgtagatttgtatccgaaacatgtcgataaaggctgagtctactttaaatgtctgaaaactcatgtctttgggagccccttgaaccataaccaccatcgtatgattatttcctccgtctatcggagttccttgggtaaaacttacccgcttcacaaaaggtagtttttgtacttcattgcggaaagtgagcagagtttcctgttctgctgctggagtaaggcagagaatgtttccgtaggtgtagcctaatggttcgtccagtatgcggtaaatttgtacacttaagtaaatggcacaactcaacatggcgatggtcagtccatcttgtacaatgttcagcacacgcaaatatacagttttggttttccggcggaagtgtccttttacaacgtctagcggattgtaattggacaggatggtagccggtacaaagccggagatgaatgacagcacgacgataagcagcaggtaagccagacaggtcacaaaagacaagtcgcccgtcaggtcgagttttacgcccagcaggtccatggcaaccggttcggcggcttttgccagtagaaatcccagtatgaaggcgataacggtcataatggacgattcgcctatcatgcgccagaatatgtcggagcgggaagaaccgagcagtttgcgggttgccatttccttggcgcggtaggtggtttgtgcaatgctcatgttgacatagttgaagatggccatgaacaagatgataatacctatgacaaagaaaagtacgaccatacggaagctgtattggttgacttctgtagaaccggaaggagtttctgtatggaagtaaaactgattgtatggcacgaattgtacttccttgaatattcctcggttatagatccaccagcaatctttcagataggagagaatatcgtttgccttcgtattcaggtcggctccttttgcggtgcggaagaatacaagtgcgctggtggcattgcccatcataccatctgtcaggctgattgttgcgttcagttcgctgatgttttcgtaagggataacagcttctgtcgattctttgagcaaagagttttcgatgttttccataataccggttacagtgaacttctggttgctgtttcctttcgcatccggcatgtccaattccagtacttttcccaaggcaggctcctttccgaacagacgattggcgcacgaacggctgagaacgatgctatggtcgtctaccagtacttgtgctggattcccttctgccagcttataactgaagaactgaaaaaagttcttgcggacagcgagtgtctgaatctgggtcgggttttcgttgatgcgggtctgtattccgaaatttccggtgtaagcacaccagtcttctatttcagggtagcggctttgcaatttttctcccagcagatagtgaccggctgctgtattttcgcttgcaaatacacagatacggtcggtatcttttaagtttttgtctactgatagttggcgggttaccatgtcggctatcagcagaacaaacatcaatgagatacttagtcctgcaacattgacaaccgtaaacaatttgttacgttgtaaaaaagtgaagtaagtttttagtcctttcatataattaatctgttttattattcagttttgatgctgtttgccgggttttcgcaggcatttttccagctctgtacggtgatggtgagcatggtaatgagcgtaaccagcaggaatgacaatatgaatatccacggactgacaggcgtcttttctgcaaatccttgcagccagtgctgcccaatccaccatccgaacggtgcggctacgatgaagcatccggtaagtatgagtatatatcttcggttgaacatgtacagaatctgtgtggtcgagcttcccataatctttctgattccgatttcctttcttcggtactcgctttcaaacatggtgagtccgaacactcctgtcaggctgatggcaatggcaatgagtgagaagagcagaatctgcttggtgaagcgcagttcgttccggtagttggcatcgagcacttcatccatgaaccggaaattgaagtcgtgtccgggggtaaacttttccattgttttctggagtgattggataacctcaattttatctactcctgccgatacacggacattaacgaaatttcgccactcccatccccattgggcaaacttcttgccggggataagaaaagccattgtttgattggcgtcgtcattgcggaagctactgtatttgatgttttcacaaaaaccgatgactaaattatcgtccggagcgggctggtcgacttttagccacggatatttcttgcgtgtaaattcgttgaagatataaacgtcctcatctcctggcttgggtcttctcccttcgacggtacgaattcccataacatccagatagcgacagtctaccggaaaagcatcaaactgaatatatttgtcgcctttggagcgtccccagtgcatgtaattatcggcggaactcaagacaaattccgaaaaggccacacctttgacgcctggaatctgagaaagttctcccactacggcgtctgtttgcgattgggtctctttggtcatgtttcctacaataattgcatctttgtcgtagccgtaatccgaagtacggatatatctgctttgcaggtacatgattcctactccgataatcagcatgtaggcaacgaagaactggatgcataccagtgcagtacgcaggatccgtccttggggagaaagtccgaaagagcctttcaataccagtgccggtggaaaagaagtaacgtaatacgacggataaagtcctgccatcagtcccataagcaggcttaagccaaaagttgcaagcagcagcatcggatgctctgttattgtcagccgggcatttaccagctcctgtaagccaaaatctttcagtatcgcaatccatataagtgcaaggataaaagctgtaaagctgatcaacatcgcctctgttatcagggtgaggcggagagaacgcgtggttgctcccagtactttctgcgtgttgatactcttgatacgcatcggggtttcggccaacgagaaattcatgaaattgatggtggctataattacgatcaggaaagaaacgcatatcagcagataaattgttgtgcggctgcttgcgcttttatttcctaccgtagaaaaatgtgcgtcggtaagtggcgtgaggcggatgaactgcgatatattactgtcctgtttcagagtcggaaagttcttcacaaaaatctgccagataagtttttctatttccggagccgcagatggactttcgagtcgcatatagcagatatagttccagtttctccagtcatttttatcggtatcggcttctttggggaccataacccagtttttaatttgtgagttttccggaaaatctttgtaaacacctcctatggtccatgcgttattgtctgcttgtgtccctctgaatattgttttgcctattacgtcggttgtaccaaagaatttctttgccgtcgattcggagaggaggaccgttttaggttggttcagcgcatcggcggtgccgtttatcatttctggctggaatgtttccaagaagttgccgaaaccggtacaggtcgttgcttcaaatgactttccgtttacttcatattcatcttcagactgatatgattcaacttgtgaaatgctctttatatagggtgaagcagattgtaattgctcacataacggacgaggggtccacagttgccagcctgaatctggattaggattaatttcaatacggaatattttttcgtagtctttatatcctttgttgaaattatagtcatagtccacctgtgtcatgatgacaaagaaggatgcaaaagcgatgcttagccctaagatgttcagtatgcttgcggtaaagaagcgcctgaatgtatgcgaaaagttacggacaagtgttttcatgggaaataatattattcagttttgatactttgtaccggattctcgttggcattcttccagcactcgaaggtcactgtcagtatcgtaatgaggctgaccagcaggaaggaaatgacgaatatccaagcacggattggggtcttgtcagaaaaactttccagccagtcgtgtccaatccaccagccgaaaggagctgccagcaggaagcagatcaccagcatgacgagataacgcttggtaaacatataaagaattttaccggtagagcttcccaagatttttcggatgccgatttccttgcggcggtattcactttcgaacagcgtaagaccgaatacaccaattatgctgagcacgatggcgattaaggagaacaacagaatttgatgagtgaaacgcagctcccgatggtagttctggtcaatcacttgatccatgaaccggaaattgaagtcacgccccggtgccatcttttctgcggcctctgtcaagcggtgaagcatgtctaccttgtctactcccggagctacccggatgttcaagacgctgttggcatcccagtctgcatgatcttttccgtaaataaagaaggtcatcggctctacggcatcgttgttacggaaactgctgaaacgaatgttctcacagaatcccacgatcggataatcttcggggacagctggttcatcaactctcatccaaggatatttctttcgggccgcttcgttgaaaatatacacatctccgtcgcccggcttgaagtcacgaccttcggtaatcttgatacccatcaccgacaagtagcggtaatctaccggaaaacagaccatattgatagaacggtctccacttcctcttccccacgacatgtagttatcggacgagttcaatacgaactgggaaatggaaataccttctatgcccgaaattccagacaattcactgacaatcgcttctctgcgatcgaggagttcgtcagggatttcacctaccagaaccacactcttatcgtaaccataatcactgttctgtatgtaatgactttgcaggtacatgatgcctacagaaataattagcatgaaagagacgaaaaactggaaacaaaccaaaaacgtacgcagcattttgcctttcggggaaagaccgaacgagcctttcaatgccagtgccggctggaaagaggtgacgtaataagagggataagctccggccagcaaacccatgcagactgcgatccctcctaaagcagctagtaagatcggatgagccgtcaacgaaagatcggatgccactaaggtacttagaggggtgcctttcagcaggtagagccagagcaaggacaacaggaagccgcatacacaaaccaataccgattctaatagcagatacactcgcaaagagacagtggaagcacccagcaccttctgggtattgatggagcgcaacctcatgggagtttctgccagtgagaagttcatgtagttgactgctgccgtcagcagaatcagtaccgatacacacagcagcaggtacaaagctgctttgctggtagccgccttgttgcctatcgtagaatagtgtacttcgtccagcggcgtaaaatggatgaaatttttccagtcttcagttccgctgatccggtctcttggaatcttctgtttgcagctttcgatgaccgactgctgtacatcggccaatgaagccggattgtcgagccggatatacatagtataattccagtttgtccaggaatctttgttcaaatccgaacgaaaagaagagaacacacagttacccaactgagagttctccggcatatcctgatagacacctccaattaccgatggataattatgagatttatggcctgtgtaaagggtcttgccaatggcatccgtggtaccgaaaaaacgacgagccatggatgcggaaatcagaacctgaccgggttcattgagggaagcagtcgtgccgcataccatagtaggctgaaatacctccaggtaatccccaaatccggtaaactcaagttctgaataaatgtgttcgtctacttcaaaatcactgggatagtttgacaatgaagttatcgaaaaggcttgtatatgaggggatgcagttcctattagttcacagaatggacgagccagccagatttgccaaccgtattctccacctggatttacttctacccggtagatgcgatcgtgtgccggataggctttgttgtagttatagtcgtagtctacctgtgtcaggatgacaaagcaggctgcaaaggcgatgcttaaccccagcaggtttagtatgctggccgtaaagaaacgccggaaagtatgtgagaaatttctgaaaagtgtattcataattcgttttgtgcttaacttgtagctgtaaattcttagtcaccgactttcaatcgtcgggtagaaacactgccgaggccatcttttgaaatatgagccgattgggctttcccgctcagggtaagactacccacaccgtccacattggcatccagttggtcacaatctactgtcagttcaccactgccaactccttccagagagacttttacgttgcgggcatgcaaatcggctatattcaggctgcctacccctgctatctcaaatttgatgtctttcaggttcagacgggatttacactcaaaggaaccgactccgtctaaaacaacttcctgtaaatcgggtgcactgaggtaaatgaaaagtccatttacctgcttgctcgttttctttctttctttggcccatgtaatcagtaattttccattcttaacggtgcatctggtcaggtccacccattctttttcaccttctacacgaagcgaataagtgtcggattgcgtgaaatatactcctgctatactttccatttcgatggaatgaaaagcactcacactacgggtttcacttacttgttctttgtttcctccttttgcactggcacagtttacacataaacaggccattaccaaactcgttaatatagttgctatctttttcatcattatcttagctttttagtttaataccagtacttcgttgtctttgtaactttcatatccggaaatgataacccgttcgcctttttccagtccttccagtacttcgtaatactgtgggttctgtcgtccgatacggattttacgacgataggctttcttcccttctttgtcgactacgaaaatccagttgcctccggttacctggaagaaagtacctttaggtatcaggacactttcagtaggttctcctaattgcagatcgatgtagtaggtctgtccgctacggatattctccggacgcttaccttggaatacgaaatcggtacggaatcgtccttcacgaacttcgggatataccttgcggactttcaggttgaaagtacttccctgtcgttcaaaggtagccggaagtccgttggctacccgatcgatataatgctcgtctatcatggcttctattttgaagtcggaaaggtcgtttatttgcccgatcatctgtccggcagtgatattctgacctaattccgcatccaggagcccaagctcaccgtcgatagttgcacgaacttccagcttatcctttctttcacgaatcagtaggacattctttcgcatgttctgtaaattgtcttccatctggtccatctgtatgttgcgatagatagaatcttgtatcagtcgctcggtaatcaatccgtgttttttctgtgccacttcatagtcttcctttgcctgaagatattcctcccggctgatgagtcgttctttgtataaacgttcgtattgaagaaaagtacgttgcttgcggcgtgtatcgatatcgagctgtactttttcggtttcgttgttcagcttatcctgctgcatggtaacttgtgtattacgcagcaggttctgtttttcggccagttccgattctgcattcagaatctgcaagtctaagtttgaattgctgaggcgaagaataacatctcctttctttacatgtgcgccttcttccaccaccttttcctgcacgatacctccttcttccggactcagttgtaccacagagataggctggacttgtccgtttactcggatgtaatcattgaacttaccataagtcacgtcggctatgttgagcgatgaggcttctactctcagcgtagaagcgtggttgccgaagataatccagattaacagaagaagaacgacaactcctccggctatgtaaggaatatgtttcttctgaatgccttttttcttttccagttgtatatccatagtgtgtaatagtttattcttttgttctgataatatcttgtcctttataataatctaccagtctgcatttcatcaggtaagtaagtttactctgtaatagtccagtctgactttccaacagcgtagctgcattgttttgtacatcgagagaggtcatcagtccttcttcgtatttgcgtcgtgttacgtgataggcaagtgagtcggatgcaaccttcttttccatctggatgctttctttcagatagccttcacggtcttgtacggcttgctgtaccagcttctgaagctcttctttttgagcttcgtattgttcggtagctatccggtaattgtttcgtgcctgacgcatgttggcaatacccgacaaacgattgaagataggaatgctcatactaatgccgaaataagaaccgaagttgttttcaaactgagtagcaaacggcggatatcccgttttatgtaattccttatagtaagagcttgaaatacctccataaaaagttatggatggaacgactgaactccaggaaatcttacggtccatctttgccgcatatttttgcatttcggcttgtttcagtgttggattgtacgtcagcgccagtcggaatacttcttcggcttgttctgtagtcagctgtatctgatcgaatgccgattgttccagcaggcaggtatccagtatcagcgagtcttcggaaggaaaattcattttctgcttcaacgtcagcatggcggtttcgtacaaattatgctgatgggtcaggttataagcatcggtggcttgttgtgcctccatctgggctacatctgccatccctttcaagccaagttcttcttgtcggcgggtcttgtagagcaacgaatcactttcagccagtttctgtctggcgagtcgggtagtcccatagtaataaagggcatcgatgtatgcttggaatgtttccaacgcggtattgtcgcgtgcctcttgtaaagcagctttgcccaatagcagattggctttgcttttccgtacctgattaatcaggcttcctcctcggaagatcgaaatagaggcttccatgctataaccattgttgaatgtcgattccgatttataagtgttggtctccggatcgaccgaacgtccaaagttatattgtgcacttacacctcctgatactcccggcaaaaattgtccgattgccttcatacgttccaaacgataattgtcggcttccagatttcgctgcttcaccgtgcggttatgatcgacagcgtaagccatgcaccggtctacattccatacttcttgtgccgtcagactgaggctgcacagacaagccagcaacaagagcggtttctttattgtgatgtttcttttcatgcattgtacattttattcgcctgatataaatcaaatatcgtgccaaaaggataatatattgattatcagtatatgccgcattgagacgtttctttgtagtgtcaaaaaattagacacctactgtctaattttttgtcacctgttaccagttcctttattttatctttgcgtatctttgcatcactgcaaataataagaatatggctaaacaaggaactttgctggttgttgatgataaccggaatatattgacttcactccaatatctgttaggagaatactttgaacgggtgattacaatcgattctccggttacaattcctactttattgaatcgggagtccattgatgtggtattgcttgatatgaatttctcttcaggtatcaatagtgggaatgaaggactttattggttgcatgaaataaaacgtctttgtccgcagacagaggtggtattgtttacagcttatgccgatatcaatctggctgtgacgggcataaaggaaggcgcagccgatttcgtggtaaagccttgggaaaatgcccggttggtacagacacttcaggaggcgtatgctcgggtcgcagatgcccgtaagggaaagaaaaagaccgtttcactttcttctacttctgatgcggggatgtattgggggaactcaccggctattcgtcccttgcgtatgctggttgagaaagtgagcacaaccgatgccaatattctgattacaggagaaaacggtacgggaaaagatatgttggcacgtgaaattcatcggctgtccaatcgcagggaaggaccgatggttgccgtcgacatgggagctattaccgaatcgttgttcgaaagtgagttgttcggtcatgtgaaaggttcgtttacggatgcacatacggaccgtgtagggcggtttgaggctgccgatggaggaacgcttttcttggatgagatcgcaaatttaccttatcatttgcaggcaaaactgcttacggctattcagaagcgttgctttgtgaaggtaggaagcaatacaccgcagcctaccaatatccgcttgatttgtgcgaccaaccgtaacttggatgagatggtgaagaacggggagtttcgcgaggacttgctttatcgtattaataccattcatttgcatatacctgctttgcgtgaacgaaaggaggatattcttccgttggcgaaacgctttctggagcaatatgcaaagcagtatggccgaccggtgcaggcttttactcccgaggctgctcgccgtttgctggagcatccttggtacggtaatattcgggaactccagcatgttgttgaaaaggctgttattttgtccgatggaaatgaattgcagggggatatgttgcaattgacatcggtcgcttcttctgctgaatctgtagccggtcatgccgagacggaaactcctttccatacactcgatgaaatggaacgcagtatggtaaagcgtgccatcgatcagtgcgaagggaatctgtcgcaagcagcagccatgttaggaattactcgtcagacgctttacaataaaatgaaacgttatgggctgtaggtggatttattcgatgccggtacgtacgttgctgcttatcgtcggagtggcactgataacgttgggaattgcagaagggaaaagtatactatgggtcgtgggagtaatttcgtgtgttgcttctgtacttgttttccggaaaatgcaacaacaattacgcgaaaagagttggctggtgctggaagctattcgaaaccgtgactattcgtttcgtttgcccgttgccggattttcggggggagaacgtgtgctgcaagatacgctcaatcgctttgggggactgatgagtgaacagaaacagctgatggaacagcgtgaacgtttttatgagcaaatcctttccagtgttacatctggtattatcgtgctggatgaagacatgaaagtagtacagaccaatccggctgctgcccgtctgttaggacttcccgtattgagtaccttacaacaactggatcggtatggtaccgaagtccctcatgtgtttcggacattgggtgctggagagcgatgtaacatacagttttctacgtcgaaaggggaagtgcagctgctggtgcgtgcttcggttatgcaattgggagaccggacggtacgaatcttagctttgaatgatatccgtaatgaactggatgcgaaggaacttgactcgtggataaagctgacacgagtactgacacatgaaattatgaattccattgctcctatttcgtcgttgagcgaaacctttctgaagcgtagtgacgtgataggaactcctttgtacgatggtatacgtgccattcatgaaacttctaccggtctgatctcgtttgtcgacagttaccgtaagttttcttccttgcaaaagccttcacccgaacctttctatctgctggatttgcttcatcaggtagaaggacttacacttgttccggagaatattgctcttactttgcagatagagcctgccgagctgatgctttatgccgaccctaatctgatacgtcaggtacttatcaatctgataaaaaatgcggtacaggctatcggcggacataagggaaggatacatgtgcgtgcatatagttcggccgatgagcatgtgtttgtgtatgtcagcaatgacggtccggcgattccggaggctgaggctgaacagatatttgtgccttttttcacaacccgtagtgagggaagcggcatcggactttctttgtcacgtcagattatgaagctttcgggaggtacaatcagtttactccgttcaggaacaaatggctggaatactacatttgtgttagagtttgaataaaacgaaacaggctgttattgttgttccgattccttgatggctattttcccgttttctttttctacattgacaatgctgcctttggggttcagactgaatggagtaatttcatcacttttgttgtcgacaatcatcagcgcattttcttctgcaaagcggttgacttgaagggtaagagctgtagaccccatggtgcagttgagcagcaggctgtcgttcacatataccgaaatgctatcgccggcaaagctgttcccaatctggatggtatataaatcgcttgaaacttttgtcttgtcggtttttgaggtacggaaactcagataaaggaacaggcatacaatgaaaaaaacaccgaaagccagaataccgtttcctatcataaactgtttgttgctgttgatacttttattgtccataatgaaataaactgttttgttttacctgcaaagatattccaaaaagataaatcttgctaaaaatgaaatatttattctgatattttgcggtacattatattatttgtatctttgcatccgagatggatgaaaaggtggaggggcggttaagctcctttttttgttcttatatagttaatacatgatagataaaaacgttgtaacccggatagttgaagaatggctggagggtaaagattatttcctggtagatgtcactgtaactccggatgacaaaattgtagttgaaatcgaccatgcggaaggcgtatggattgatgattgtgtggacttaagccgttatatcgaatcgaaactgaaccgagaggtcgaagattatgagcttgaggttggttcggcgggaatcgggcaaccttttaaagtacttcagcaatatattattcatattggcaaagaggtggaagtgcaggataaggacggaaagaaatggaccggcgtattggtcgatgcaaatgaatcgaactttacgattacggtgcagactaaagtaaagcctgaaggcgccaaacgtccgaaactggtagaacagaatgtgacctttacttatgacgaaataaaatacaccaaatacttaataagctttaaataaaattatggcgaagaaagaagcaactgtcagtttgattgacacgttttcggaatttaaagatttgaagaatatcgaccgcaccacgatggtgagcgtactggaagagtcatttcgtagtgtgatagcaaagatgttcggtactgatgaaaattacgatgtaattgtaaatcccgataaaggcgactttgaaatatggcgtaatcgtgaggtggtggctgatgatgagctgacgaaccccaatatgcagatttcgcttactgaggctcgcaaaatcgatgcatcgtacgaagtaggagaagaagttactgatgaggtgatattcgagaagttcggtcgccgtgcgatattgaatcttcgccagacattggcttctaagattttggaactggaaaaagacagtttatacaataagtatattgataaggtcggtacgattattgctgctgaagtttatcagatctggaagaaggaaattttgctgctcgatgacgagggtaatgaattgctgcttccgaagactgagcagattccaagtgacttttatcgtaaaggagaaaccgtacgtgctgttgtggcacgggtagacaataagaataacaacccgaagattattctgagtcgtacctctccggtattcttacagcgcttgttcgaacaggaagttcctgaaatcaatgacggattgattacaatcaagaagattgctcgtattccgggcgaacgtgcgaaaatagctgtggagtcttacgatgaacgtattgatccggttggagcatgtgtaggtgtaaagggctctcgtattcatggcatcgttcgtgaattgcgtaacgagaacatcgatgttatcaattatacttcgaatatacaattgtttgtacagcgtgctctgagtcctgccaaggtttcttctatcattatgcatgaagaagaaaagaaagcagaggtatatctgaaaccggaagaggtttcgctggctatcggtaaaggtggtatgaacattaagttggcaagtatgctcactgagtataccattgatgtatatcgtgaactggatgaaaacgcaaccgatgaagatatctatctggatgaattcaaagatgaaattgatgaatgggttatcaacgccattaagagtattggtatcgatacggcaaagggcgtactgaatgctccgcgtgaaatgctgatagaaaaagctgatttggaagaaaacacagttgatgatgtgttaagaattttgagggcagagttcgaggaataataagacagactttccgtgactgaaaacctttttccctgaactctattaaaaattaaaagaatttatgacgataagactgaacaaagtaacaagagatttgaatgtaggtattgctacggtagtggactttttgcaaaagaaaggatatactatcgaggcaaatccgaatactaaaattactgatgaacaatatgctgcacttgtgaaagagtttagcaaagacaaagatttgaaaatagagtctgaaaagatttttcaggaacggcagaataaggaacgaaataaggcttctgtttctatcgatgacttgcaggctgaaacaacaacaaaacctgaagtgatagaaacagttgtacccgaagatgcacgtcctagatttaagcctgtaggcaaaattgatttggacaatcttaataagaagaaggtgaagccggctgtggtggagcctgctaaggaagaaaaaaaggaagtggtagaaactgctgaaccagtggaaaagcctgcacctgtacaagtggaggaagaaactgtcgcggaagttgcacaaccgcaacctcagattaatgaacaacagaaacagccggaacaggagaaggcagaagatttgataccagatttgatggaagaaaagaaagaaacccccgaagcacagaccgttcaacaggacaaggaagatgaagtttttaaaatacgtccaacggaatttaagtcaaaaataaatgtagtaggtcagattgacctggctgcactgaaccagtctacccgtccgaagaaaaaaacgaaggaagaaaaacgtaaggaacgggaagagaaagataaacagcgtctggaacagcgtaagcagatgaaggatgctattatcaaggaaataagaaaaactgacgaaaaagcagataaaggcggtcagaatgatgttgcgggaaagaagaaacgtaatcgtataaataaggaacgagtagatattaatgctgccggtagtatgactgcacctcgtggaggtgataacaaagctggaaaaggtaactccaatgctgctcaaggtggaggaaagcataataaagaccgtttcaaaaagccggtagttaaaccggaagtgagcgatgaggatgttgctaagcaagtaaaggaaacattggcacgtcttactaataaaggaaagaataaagctgctaagtatcgtaaggaaaagcgtgaaagcatacagaatcgtcaactggaacaggaggaactggaacaggaagaaagcaaggtactgaagttgacggaatttgttacggcgaatgagctggcaaatatgatggatatttcggttacacaagttatctctacttgtatgagtgtgggtatcatggtttccatcaaccagcgtctggatgcagaaacgattaacttggttgctgaggaatttggctacaagacggaatacgtgagtgctgaagttgctcaggctatcgaagaagaggctgatgcagaagaagatttgcagccacgagctccgattgttacagtcatgggtcatgttgaccatggtaagacttcattgctcgactatatccgtaaggcaaatgttatcgcaggtgaagccggaggtattacccagcacatcggtgcatataatgtaaaactggaggacggacgtcgtatcacgttcctcgatactccgggacacgaagcgtttacggccatgcgtgctcgtggtgcgaaggttaccgacgtggttattattattgttgctgccgatgataatgtgatgccgcagacgaaagaagctatcaatcacgcgatggctgccggagttcctattgtgtttgctatcaataagattgataagcccaatgctaatccggacagaattaaggaagaactggctgctatgaacttcctggttgaagaatggggaggtaaataccagtcacaagatatatcagcaaagaaaggtaccggtgtacatgaattgctagaaaaagtattgctggaagctgagatgcttgacctgaaagctaatcctaatcgtaaggctacaggttctatcattgaatcttcactggacaagggacgtggatatgtggctacagttttgatttcgaacggtacgttacacgtcggcgacattgtgctggctggaacgaactatggtaaggtgaaggcgatgttcaatgaacgtaaccagcgcttgaaagaagctggaccgtctgaaccggtactgattttgggattgaacggagcgcctgccgctggtgatacattccatgtattcgatactgatcaggaagctcgtgaaatcgccaacaagcgtgaacagctggctcgcgaacagggcttgcgtacgcagaagatgcttacactggatgaagtaggtcgtcgtctggcactgggtgacttccacgaactgaatgtaattgtgaaaggtgacgtggacggttctgtagaagccttgagcgactcactgataaaattgtctaccgaacagattcaggtgaatgtgattcataagggagtaggacagatttctgagtcggatgtatcactggcagctgcatcagatgctatcatcgtcggtttccaggttcgtccgtcgaacaatgctgccaagcttgctgaacaggaaggcgtggatatccgtaagtattctatcatctacgatgcaatagaagaagtgaaagcggctatggaaggtatgcttgcacctacattgaaggaacaggttactgctactatcgaggttcgtgaggtcttcaacattagtaaggttggtatggttgctggtgctatggtcaagacaggtaaagtaaaacgttccgacaaggctcgtttgattcgtgatggtattgtaatctttacaggtagtatcaatgccctgaaacgtttcaaggatgatgtgaaggaagtcggtacgaactttgaatgtggtatcagcctgaccaattgcaacgatctgaaggtgggcgacgttattgaaacttacgaggaagtagaagtaaagcaaactttataattacattataatatctttaatgaggtgatgtcatcctgagcatagcgaaggatctgtaaacgctatcggaagtgtacagattcttccgttggttcagcatgacatttccttttttatgggagtgaatatgatagtcctcgattggataattgtaataatgataggtatgggggcggtacttggcttttccaaaggctttatcaggcaacttgcttctattgtgggactgattgcgggcctgctcattgcccgagctttgtttgcttcggtgggagaaaggctggccgaagaactgggaacaccacttacctttgcacaggtcgtggcctttatcttgatatggctggtggtgccaatcgtatttttgtttttggcttcagcacttacgcgtgtcatagatattgtcaagctgggctttgtaaaccgtatgctgggagcagggctgggggcactgaagtatatgctcctggtaggcatagccatacattttattgagtttgtcgattctaaagataacttaataaagtcaaccgtaaaacaggaatctgtgttatattatccgatggaagatttttcggatattttttatccgactattaaaaatgtgactaaacaactaatagactgatataataaagtatatgcaagaagaactcaatatgaaggatgaatcccagaagaacgagtttgtaaagcagcttacgcaggaaaaatacaaatacggttttactacggaagtgcatacagacatcattgaaaagggattgaatgaagatgtggtacgattgatctcggccaaaaaaggtgaaccggaatggttattggagttccgtctgaaagcttatcgtcattggctgacaatggaaatgcctacatgggctcatctcgatattcctgaaatagattatcaggccatttcgtattatgccgacccgactcaaaagaaggaaggtccgaagagcatggacgaagtcgatccggaactggtgaagacatttaataaactgggtattccgctggaagagcagatggcgctgagtggtatggcggtagatgccgttatggactctgtttctgtaaaaacaacctttaaggaaacactgatggaaaagggaattattttctgttccatgagtgaagccatacgcgaacatccggatctggtgaaaaaatacctgggctctgtggtaggttatcgtgataatttctttgcagccctgaactcagctgtgtttagtgacggttcatttgtttatatacctaagggagtacgttgtccgatggagctttctacttatttccgtatcaatgcagcgaacaccggacagtttgaacgtacgctgattgttgccgatgacgacagttatgtctcttatctggaaggctgtacggcaccgatgcgcgatgagaaccagttgcatgctgcaattgtggaaatcgttgtcctggaccgtgctgaagtaaaatattctactgtacagaactggtatccgggtgatgctgaaggcaagggaggtgtatacaactttgttacgaagcgcggaaactgtaagggagtagacagcaagttgtcgtggactcaggtggaaaccggttctgccattacatggaagtatccgagctgtatcctgagtggagataattctacagcggaattctattcggtggcggtaaccaataattaccagcaggccgatactggtaccaagatgattcatctgggaaagaatacccgctctaccattgtaagtaaaggtatcagtgccggaaagagccagaactcatatcgtggactggttcgtgtgtcggaacgtgcagacaatgcccgcaactatagtcaatgtgactcattgttgttgggtagtcattgcggcgctcatacattcccctatatggatatacacaatgaaacggcagttgtggaacacgaggctaccacttcgaagatttcggaagaccagttgttctattgtaaccagcgtggtattccgactgaagatgcagtaggcttgattgtaaacggttatgcgaaagaagtgttgaataaacttcctatggagtttgccgtagaagcacagaagttgctctctatttcgttggaaggcagtgtaggataaataaaaaagaacgttatgttagaaataaaagatttgcatgccacaattaatggcaaagagatattaaaaggaattaacctgacagtaaagtcgggtgaagtacatgctatcatgggaccgaacggttctggtaagagtacattgagcaacgtactggtcggtcatccggcttatgaagtaacaaaaggctcggtaactttcgacggaaaggacttgctggctatgagcccagaggaccgcagtcacgaaggattgttcctttcgttccagtatccggtagaaattcccggtgtaagcatggttaacttcatgcgtgcggctgtaaacgaacagcgtaagtataaaggacttcctgctctgactgcaagcgagttcctgaagctgatgcgccagaagcgtgagattgtggaactggacagcaagcttgccaaccgttccgtaaacgaaggattctccggtggtgaaaagaaacgtaatgaaatcttccagatggccatgctggagccgaagctgagcatcctcgatgaaactgactctggactggatattgatgcgctccgcatcgtagccgaaggagtgaacaagctgaagactcctgaaacaagctgcatcgtgattactcactatcagcgcttgctggattacatcaagccggatatcgtacacgtgctttacaaaggacgtatcgtaaagactgctggaccggaactggcgctcgaactggaagaaaaaggttacgactggattaagaaagaattaggagaataagcatgaaagcagaacaacaatatattgatcttttctcgcagtgtgaggcgatgatttgccggcatagtgccgaggtgctgaatgctcctcgtgcaaaagcgtttgccgacttcgaacgtctgggcttccccacacgcaagcaggaaaagtataaatacacggaggtgagcaagtattttgctcccgactacggactgaacctgaaccgtctggagttcccggtcaatccgtatgaagtgttcaagtgtgatgtgccgaacatgagtacttcgctctattttgtggtaaacgatgcattcgacaagcacgtacatccttctgcacaattgcccgaaggagtgattttcggcagtctgaaagatatggcagaacagtatcctgaactggtgaaaaaatattatggcaagcttgccgatacgtcgaaagacggggttgttgcctttaataccatgtttgcgcaagacggtgtgctgatgtatgtgccgaagaatgtggtcgtagaaaagccgattcagttggttaacatattgcgtgccgatgtcaattcgatggtaaaccgtcgtattttgatcatccttgaggatggtgcgcaggctaaattgctgatttgcgatcatgcaatggatgaggtgaatttcctttctacgcaggtggtggaagttttcgttggcgaaaatgccgtattcgatctgtatgaactggaggaaacgcacaacagcacggttcgcttcaacaatctgttcgtcaaccagcaggcaaacagtaatgtattgctgaatggcatgacgcttcataacggtacaacacgcaatactaccgaagtaacgcttgccggacaaggagcggaaatcaacttgtgtggaatggctattgccgacaaaaacgaacaggtagataataatacgttcatcgaccataaggtccccaattgtaccagcaatgagttgtttaaatatgtcctcgacgatcaggcagtaggagcctttgccggtaaggtactggtgcgtgaaggagcacagggtacttcatcgcagcagacaaaccgtaatatttgcgctacgcgtgaagcgcgcatgtatactcagccgcaactggagatttatgccgatgatgtgaaatgttcgcacggagcaacggtcgggcaactcgatgaaaatgcgttgttctacatgcagcagcgtggtatcagcctgaaagaagcacgcttgttgctgatgtttgcctttgtaaacgaggttatcgacaatatccggatggatgcattgaaagaccgtttgcacttgttggtagaaaaacgtttccgtggcgagctgaataaatgtcagggatgtgctatttgtaaataaataatcgtgtgaaatgttttacgatgtacaaaaaataagagaagactttccgatactttcgcgaaaggtgtacaacaaaccgttgatttacctcgataacggggcgacgactcagaaacctcgtgtggtggtagagtcgattacggacgaatattattcggtcaacgccaacgtacatcgcggcgtacatttcctttcgcagcaggctaccaacttgcacgaggcttcgcgtgaaaccgtacgtaagtttatcaatgcccgcagtacttcggaaattgtctttacgcgcggtacgaccgaaagcatcaatctcgtggcatcgacctttgtcgacagtcagatgaaggaaggcgatgaagtgattgtttcggtcatggaacatcatagtaacatcgtttcgtggcagttgcaggcggcgcgtaagggaattgtgctgaaagtgattcccatgaacgaccgtggcgaactgttgctcgacgaatatgagaagctcttctctccgcgtacccgactggtatcggtggctcatgtttcgaatgtgctgggaaccatcaatcccgtaaaggaaatgattgctacggcacatgcacacggggttccggtgctgatagacggtgcacagagcattcctcacatgccgattgatgtgcaggatctggatgccgatttctatgtgttcagcggacataaagtatatggccctacgggtatcggtgtactttatggaaaagaagcgtggctcgacaagctcccgccttatcagggtggaggagagatgatcaagaatgtcagcttcgagcatactacgttcaacgagctgcctttcaagttcgaggcaggaacacccgactacattggcagtacggcactggcaaaagcactcgattatgtttcagctatcggaatggataagattgcagcttacgaacatgaactgacggtatatgccatgaaccgcctgaaggagattcccggcatgcgtatcttcggcgaagctgagcacaagggaggagttatttctttcttggtagggaatatccaccatttcgatatgggtacgttgctcgaccgtttaggcatagccgtgcgtacgggacatcattgtgccgagccgttgatgcaccggatgggcattgaaggtacggtacgtgcctcgttgggactgtacaataccaaggaagaaatcgatgcgctggtagccggtatcgaacgggtaagtcagatgttctgataggctttttggctgtttcgtaatgtcggaatccgatagtgcgattcagttgcgaatgcgaaagtcactttataaatcaaatatttatacaaaggagatctccttgttccacctgatacaatgaatgtcagggttggagcgaggagatttttttatatcgtaaccagtcggtttgtcggctgcttggtggtatctgccagcagttattttctatcgtgtgtaaattatcgccttgtttcgaaaaaacgtcggcggaaagtggtgtaaacgtcggcatgttttcagaaatttgtctcgacgtttttttatcttttgtacaaaaaataaaaatgtttgtacaaaaacaaaaaggctcgtgccgggcagagattaagaatgacagcaggaacctttgttaatgtttagaacgaacaaaagaacgttacgaggaacggtacactgaaatcggttatgaaaccatggaagatggatacaattacaaactgctgacctgccgtgcgggtaatgatgggcagggtggtatccatcgtcgttgctcctccggcagagataggagccagatttccgaaccagcggaccagcaggggagcacaaagtaaggtcatgatttctcgtaggatgttggaaaggagggcaagagtacccagctccggacctttgtattgggtgatgaagatgctggatagcgagtaatagcccatacctgagcctatcgccatgcattcgcttacgcttcggtggggcaggatgaggctgacaagtgccgctgccgacaaggtacctaaaatagtggctacgggaagcagtaccagtcgcggattcagagaacggaaatttcgtaaggtctgcggatcattcccgatgctgatacctacgctgaacatcagggcgcacagtgcataaaagctgatattgctctgactgaggtcggaaggtagaagatggaacattccacagagggtaccgagcaggaagaatcccacaataatcagactgcctttcatgccttgcctccttttcttttatacaaccagcgccacagtccccaggcaagaaggcaactgcctgtcagacaggcgagcgtaataataagggcttctattcccagtgtagcaagaccttctataatctgacggttattcccgacctccagtcctaggagaaacagcagtatccagatcagcacggtgatggccttgccgatccatgaaaggttttgacgacggagcacaaagccggtcgccatacctcctagcatacatccgataacagtgaacatgggcatgatttttagtcggatgcaaaagtaaggaaaagccgttgtaagaacaagcattccgcggtgtagtggataacttattgataacttggtctcataagtgacctttgttttgcctgaaaactcgtacctttgcagcccgaatttaaaacgacgtatatgttattgccttatctgcataaagatttgattgaagccggatgcgatgaagccggacgcggctgtctggcaggagcggtctacgctgcggcggttatcttgcctgccgattacgaaaaccagcagttgaacgattcgaagcagctgacggaacatcagcgttacgccttgcgtgaggtcattgaacgggatgcaatagcatgggcggtaggagtcgttacaccgcaggagattgataaaataaacattctgaatgcatcttttctggctatgcaccgtgcgatagatcagttgaaggtgcgtccgcagcatttgctgattgacggaaaccggtttaataagtatcaggatcttccgcatactacggtagtgaaaggagatggcaagtatctgtcgattgcggctgcttccattctggccaaaacttatcgtgatgattacatgaaccggcttgccgaagaatatccccagtacgactggcagaaaaataagggctatcctaccaaaaagcatcgggaagcgattgcccgctacggtacgacaccttatcaccggatgtcgttcaatttattaggcgacgggcagctctcattcgatttctgaggattgaacgcttgttgttacgtcatacttatgaacagcctgttgataactctgaagttattaacaggctgttcataatttataattatgtaataagattgaaaccggtttgttttcttatcttcaacacactgtcgtacgttcttaaaactgtttcagttattttgccccaaaataaattcaatctagtgtatgaggaaaatatacaggcaatggctgtgcatggcggttttgctttgccagataacggcgcaggctgccgaaaatggagctgtagtaagaggaactgtcaaagatgtgcaaggtaatcccatagcgggagtggttgtaactgatggaaagaatatgacggcaaccgataatcgggggatgtatttgctggataccgatccggttcgtcagccgatggtatatatttcgactccagccgactatgtacttcctgaaaagaatggaattgctgatggcttctatcgctatcaggatgccggtaaaacggaaaatcaatgcgactttatacttcagaaacgggagaaaaagacggatgaatttgtctttattcctatttcagacccgcaggtaaagaatgaacaacagttggaacgctttcgctcggaaacaatccccgacttggtgtatacggtcgattcgctgaaccttcccgaaacgatcggcatgcaactgggtgatttggtgtgggatgccatgaatttgtatacgccttatcggactacgatttccgatctgggactgaccatgtttcagataatgggaaaccatgactttaacttgcagtatgccgatatggaacgtacggcagaaccggcgaaaggatacggagagaagaactattatgaaatgttcggtcctacggattactctttcaatgtaggaaaagtgcatgtcattgccatgaaggatatcgattatgaaggcggtaagaaatatacagaacgctttaccgaagaacaacttgaatggttgaagaaggatttaagttatgtgcccgaagggactactgtctttttgaatgttcatgctccggtagcgaatacgacggtggaagggggagataatgtgcgtaatgccaatgctttgttccgcatcttacgaccttataaggctcatatcttttccggacatacgcacttctatgaaaatacacttccggcagccggaatatacgaacataatatcggggctgcctgtggagcctggtgggcaggtgatgtaaaccgttgcggcactcctaacggatacttggtagtaaccgtgaagggggatgatgtaaaatggcggtataaggcaaccggccgtccggcagattatcaattccgtctttacaagcccggagaatttgaaacacagaaacaatatgtcgttgccaatatttgggattgggatatagcatacaccgtaaactggtacgaagacggcgtgctgaaaggtgccatgcaacagtttgacgatgaggatcaggactatctgaatatggaaaaaggagagcgtaccggttaccatacccggcatttgttccgtgcttgtccttccagtcaggcaaagaaaataaaggttgaggtaaagaatagatttggcgaaatttttacacaggaagtagaattgtagaaatacctgttttttattttgatgattccccctttcagtctgcgtgaagatagaaagggggactgtttttttggcagttctgtctggcagagttcgttatccgttgaggacgatgcataaaaagagtgaaaacttattcttaatacgagggatattttgtacttttgcatgttgtaaagcatgcactcgatatatcaacttttaaacaaaataatattatggctaagaaagctcttttaatgattcttgatggttggggatgtggcgaccacaagaaagatgatgtgatctttaatactcctactccgtactgggacagtttgctggcagaatatccgcactcacagttgcaggccagcggcgaaaacgtaggtttgcctgatggtcagatgggtaactctgaagttggtcacctgaatatcggtgccggacgtattgtttatcaggacttggtaaagatcaaccgcgcttgtgccgacggtagcatcatgcagaataaagaaatcgtttctgctttctcttacgctaaggaacatggaaagaatatccatttcatgggattgacttcaaacggtggtgtacactcttcactggatcatctgttcaagttgtgcgacatcgctaaagaatacggactggaaaatacatttattcactgtttcatggatggtcgtgatacagacccgaagagtggcaagggctttatcgaacagctgactgctcactgtgcacagtctgaaggtaagattgcttctatcatcggccgtttctacgcaatggaccgtgacaaacgttgggctcgtgtaaaagaagcttacgatttgctggtaaacggtgtaggtaagaaggctaccgatatggttcaggctatgcaggaatcttacgatgaaggcgtaaccgatgaatttatcaaaccgatcgtaaacgctaacttcgacggtacaatcaaggaaggtgatgtagttatcttcttcaattatcgtaacgaccgtgccaaggaattgactatcgtgctgactcagcaggatatgccggaagaaggtatgaagactatcccgggattgcagtattactgtatgactccgtacgatgcttcattcaagggtgttcacatcttgttcgacaaggaaaacgtacagaatacattgggcgaatacctggctgctaacggaaagactcagctgcatatcgctgaaactgaaaagtatgctcacgttactttcttcttcaacggtggtcgtgaaactccgtatgataacgaagatcgtatcctggttccgagtccgaaagttgctacttacgacttgaaacctgaaatgagtgcttatgaagtaaaagataaactggttgaggctatcaataccaagaaatacgatttcatcgtagtaaactatgctaacggtgatatggtaggacataccggcgtttacgaagctatcgaaaaagcagtgaaggctatcgacgactgtgtaagagatacagtagaagctgccaaggctaatgactatgaagtaatcatcattgccgaccatggtaatgcagatcatgctttgaacgcagacggtactccgaatacagctcactctttgaatccggttccgtttgtttatgtaacagcaaacaagaatgcaaaggtggaaaacggtgtattggccgatgttgctccttctatcttgcacatcatgggtatggctcagccggctgaaatgactggtaaagacttgattaagtaattgataagttcctttatattctttatatcaagaagggaatagcccgttgggttattccctttttttgattgctacagttctgtactgcatttctcggctcaggttttcggaagtcctttcgtgtcgtttcttttctgctgtatcataaactccttgcaattatcttttgtgatacaataaaattccataactttatgcttcagaaatagaagccgtcggcttgcctgttatactggtgaggctcatgtagatcgttttattgcataatgaccaaccgactgctttactcttgaattgaacttatgtaaatatgctatgacaaaccgacaattggattttgagaacatccatagagtggaaaatctcacctacgaaccgctggaaaagaaatatatcaaagtgcaggtcgtaataacgatattagtgtacatctgtatgatgctccttgcgctgctcctccttttgaaagaaggattgccctatcgaacactcattgttgctggtctggaaggtctgttactttgtgcagctatcgttaatctgcttcttctccccaaggcgtatgcctgtaaaggattcgcttttcgtgagcacgacatcacctaccgttccggactctttttcccgactgttgtaacgattcccttgtgtaaggtgcaacaagtgagcatacagcaacatcctgtcagcaagctgttgaggctttattctgtgtctattgtaaacggagcacagtttgaggcggaaacagttattccgggattgacgaaagagagggcaaacgtaatgaaaacaatcataatggagtacatacaacatggaaaaatctgacttctctgtgccgcgcagaatgagtaagagtgcctttgtcattctgttggtaaagggattggtgggttatgccggtccgtttattatttgggctcttctcaagttgtttaataccgacaaacagcgttcctttatggaggtcatgagaatattgctgtttctgtttatctgctatctggtattttctgtcgtgacggcgtttattagttattattacaagaagtattatattaaaaacgggaatctgattcttatctacggatttcttaagaaagaaacaaccataccgctgcagaaagtgcagtcgttaagaacccgacggggctttatgtatcgtctgctcgatatgaaaggagtttcgttcgataccctcgcgtccaaggaagaggaagtggaacttattctggattataaagattgggatgctctgattgaaaggattgaacagcaggaacaagcgctggaggaggataagcaaccggtggaagaggataacataatccgggaagcaaagcctgtcacgaataaatatacgctgaaactgagtaacctgaatctgataaaaggggctttctgtcagaatcattttcggggaatgattgtgttattgggtattctgtttactttctacgataaaatactttcggcaagcgatagaatcttgaatctcttcatcgattatgtcaatgagcatgccgattatacttccctctcggtaacggtattcgtgatatttcttctcctattgtatgttattgtaatggtattatggatcgtgaaagtgttcatgcgttactataacatggaggtacagaccgacgatacgcaactgttctttgagagtggtttgataacccgattcagtagtcgcttttcgtacgataaggtttgtacggtttatgtcaaacaaaatatcttggagaaatacctcggctgctgtacaattatgttgaagcaggcgttcaatgctaccgaagaaaaggatgagagtgatgtaaagatatatggttcgaatttctccggacattttctgaactggtggttgggcaaggattatgcttcttcacaaaccattttatcggcaaaatccggtaaaggagtcatcggttacaccatgcggtttgatcttcctgtgtgtctgatagtttctgccgtattatgttattaccacctgtacccatggctggcaatacctgtagtctatatgctgatatctttgttaaagggaattttggcagctcgccggagctgcatcacgttgaaagaagattatattgagatacataacggtaagttggccgatatcaggaactatattaaatacaccaatgtggaagtggtcagtctgagacgaactccgtttactcccttcttccatcgtgtgactctgatggtttccaccaacggaacttcttttaaggtgagaagcttgaaagaaaaagaggcaaacgatgtttatgagtttctgatagataatagccggtcacaggaagtaaccgaaatgtgaagtggcaaaaaatgtgagctcgatataaaatcggggaatggcaagctggcacttgttaacaagtcagtcgtttaacaaacgccgtgccggtaaatgattttatatcaagctcatgttaagattagcagatcccttttatccggtcttcaaaggcagaaagggcagctttggctccttcgcccatcgatatgatgatctgcttgtaggccacgtcggacacgtcaccggctgcgtagatgcccggtatcgcagtgcggcaattgcggtcgaccaagatttctcccatccggttggtttccagtgcttcggcaaagggccggctgttggctgcaagtccgatctgtacgaatacaccgtccagcggcaacaggctctcggtttcatcctgtcggttcttgatgcgcagcgcattcatggcctctccgtttccttgtacttctagggtctgaacggaagtaaagacttccacgttggtcagtgaatgcagtttgttctgtaatacctgatcggctttcagagtatccataaactccagtacggtaactttcgagcagatacccgccaagtcgatggctgcttctactccggaatttcctccaccgatgaccgctacatgcttccctttgtagaaaggtccgtcacagtgcgggcagaaagcaactccacgaccgatgtattcggcttctcccggtacgttcagtttacgccaggaagctccggtggcgataatcaatgccggagcgaggaacttttcccctccttttacggtgagtactttctgtcctccctgcagggagaatgtttctatctgacggttgtcgcaaatggtaatgttctcgtaatgtgacaagtgagtgcgtaagtcggctgccaaggtctgtcctgtagtgtaagaaacagaaatgacgttctcgataccgacggtctcatttacctgtcccccgatacgtccggctacgacagccactttcagtcccttacgtgccgagtagatggctgcggcaactccggcaggtcctcctcctgctaccagtacgtcgaaatgacgttcttctgtcactggctggtaagaagaatcggttcccattttgctttccagtttatccagcaattctcctaatgtactgcgccctacatgtatggaggttccgtccagccagacagaaggaaccgcctgaatgttgagccgttgaacttcttctgcaaataatgcaccgtcgacgatacgatgtgatatacggggattcagtaaggtaatgatattgagtgcctgtaccacgtcgggacagtttgtacacgaaagcgacatgtaagtcgtcagtgtggcattgccttgcaagtgttcgattctccgtcgggtagcatcatcgggaagatttttcccttttccgtcggcattcagcacggcaagcagcagcgaactgaactcgtgtccgttgggcactgcctgaaagtagatgcgcaactcctctccgtttctcaggatacggaattccagtccttcaccgtcacggacggtacacgatagcttatccgagcaggaagctgtatcttccagcaattcgatcagttcgttgcggctttcgtgctgaggatgtacggctatgtcgaacacgtattcagcatccagtccggcaaaaatctgtttgagttgtgctttaaacgctgtatccaacataagcagttctccttgttcttatcagattttacctaccaggtcgatacttggcttcagggtttccttgccttgttcccatttggcagggatacttcaccgtcgtgagaagccacaaattgagctgcttgtaccttgcgcagcagttcgtcggcgtttcgtccgatgctgttatcctgtatttctaccagcttgaccagtccttccggattcacgacaaaggtaccacggtaggccattccgtcttcttcaatcatgacaccgaaggcacgtgacaaagctcctgtcgggtcggcaagcatcggatactgtattttgcggatgctttcggaagcatcgtgccatgctttgtgtacgaaatgtgagtcggtgcttacggaataaacttctactcccatggctttgaactgttcatacttctctgccatgtctaccagttcggtaggacatacgaaagtgaagtcggcaggatagaagaaaaatatagcccatttccctttgatgtcttcgtttgatacggtgatgaactgtccgttgtgaaaagcttgtaccttaaattcgggtactcttgagttgatgattgaattcataaaatgtatgtttttaaattattatttattgttttttaaatttgtaatgattacaatgtaaaggtacggtcctcttgttagatgggcaatacctacttttaggtatattgcatgattcctatgccatatcttttttgtatttttgcgccgtaatactaaaggtagattataaagagatggtacagatagacgatgtaatagtcagtctggatgttttccgcgagaagtttgtctgcaacctcgatgcctgtaagggagagtgttgtatagaaggtgatgcgggagctccggtagagctggaagaagtggagaaactggaagaggtattgcctgtgatatgggatgatctttcccccgaagcacgtgccgtaatcgataaacaaggtgtagtttataccgattcggaaggtgatctggtgacttccatcgtaaatggaaaggattgtgtgttcacatgttacgatgaaaaagggtattgttactgcgcaatcgagaaggcttatcgggaaggacgttgtaatttctacaagccggtatcgtgccatttgtatcctatacgtgtaagcgattacggaccctacaaggctgttaactatcaccggtgggatgtctgcaaggctgccgtactgttaggcaagaaagaaaatgttccggtttacaagttcttgaaggaacctttgatacgtaaatttggtgaagcatggtatgccgagctggaaaacgtagcagaggaattggaaaagcaacatattatttagtagatagcaagttggtgcagagagacaaagtcagaaatgttttgttctactctgcaccttttttataaaagaaagggctttctattttagcttgaaccgtacagtctttaccggtcgtaagtaataatctaccgtctttccggcatccagtatgcgattgtttgccagactgaaagtggactgtccgtcgttgcataagtaacgtgctccatccgtatatttaaatcggtcgaatccgtattcagaaataaaagtattcaggtcgtttatgctcgcctgaaactggtttctgaaagcgactgcctcttccgttgtaaacattctccatccacttatatcatctttttcgtaagcctccagcagtccggcagcatctgctgccagggtgtaccattggtcgggcgctataaggatagccttgctttcggtagccgacaatgatgtgacttgccagacataaaaatatccccatatcgtatcggcatcaggcagctcgggaacgataaaagtatcggtctcttctgtatcatccggtgtttcggtgctgccggtgttgtccgaatcgttgtcatcttttccgctgtctgtattatgatcgtcgtcaccctcatcgggaagaatttcatcaaatccgaattcacagtcgacttccggttgccatccgtcggcctgaaactctccgtcgagcgatacttctcctttataatatccggtaaaatgatagggatatcctgccttcagtgttgcctgatacgtatatccataggtttcgttgccgtcgggagtctgaatgtttatcgacagatgggtttgtgaactctcgttcgggaagatatataccgcatcgcttatccagcggttgccttctttccggcatgaaacagtgcattgacgtttgtcattcttgtcgtcaccgttgaacgaaatacccgaactgaccggtgaaatgcttacttctgtcgaggtagcatgctcagggatgccgttaagcgtaaaggtaagcgaagctacgacatacgaaagtgtgagggtgattcgggtggactgggtgaggttgacactggcctttcccatttgcagcggtttatccgagcaattgttgttccgtagcgtaatgtaactgtcggggatgatttctagcggatacgaatagttgttatccgtcagccccgacaataggaccattgtgtatttccctttcggcatcgatgagctgtattcactgttttcgtcgggaatattttcttgcgccacacagttgttcttgtcatcgaacaggaagagcgacagcggatagttgagcttggcgttgtcctgactgccgatattcagttgcagtgtgtacgaaacttcgttttcggtctctccggttgtcccgttttcttcttgttccagctggtattccccacaggcacaaagcagaaacaggcaggtaataagcaagatgtttttcatcgttttcataggtagcttgttgctttttctctttactaacgcaagttgatgaaaaaatgtaccgtgcgatgaaatttttttcgagagacctggaatttttcttcactggaagggaacagaaatttgtacaaattttctgcgtttttgtacaaaaaataaaaaaatgtcccgacgttttttcggagagaaagtttggagtttccgaaaacgtcgggacatctctgtaaacgtaagatgtggttatttttgtacctcttccatgactctcaggaagtttcctccccatatcaggcggaggtcggcttcgctgtagcgctcatagagcaaccggcgtgtcaggtttatcagttctgaagaatcgttacagccgatgatgcctccgtcgccgtcgaaatcggttccgatgcccacatgttctatacccatgatgttgaccatgtgatgcaggtgctcgatggcatcgcagattgttgccggtgcgtccgaacggagaaaaccgccgtacagacaaacctgtacgactcctcctttgcgggcgatagctttcagttggtcgtcggtcaggttgcgcggatggtcgcacagcgcacggcaggaagagtgggagcagacaaccggctggctgcttatctccagcgtatcgtagaaggtctgttcgccggcatgcgacaagtcgaccatcatacctgtacggttcatctcacggataacctgttcgccgaaaggtgtgacaccgatcttctcatcattgtatcttgccgatccgcagatatcgttgttgccgttgtggcagagtgtcatgtacactactccgcgcttgcggaaacgttctacattcgtcaaatcttttccaatagcatatccgttttctattcccagcatgattgcttttttcccttcccgtttcaaacgataaagatcggctggcgtgtaagcaatatctaccgccgtacagttcatggcgaccatacgctctatttcattcagcagctggtcggccttggctgtcgcagccagtaaggcttcgtcggtacgttccttttgtgccagataagccaccatgatggttgcatcctgacgtccttcggtcatcttgtgtaagtcgacctttatcttcggatcgcgtgtggcgaaattgatatcctgtccgaagaacatcggcgtatcgcaatgactatctagtgtgagtatacggtgatgcatgcgtttcgctgtgcggaaagaagcagcctcctgcaacagccattcgaagagcggcatcatgtattcgtcatcgttcaggataaagcattcaggatgccattgtacccccagcatcgacttatattctgtactttcgatggcttcggctacgttgtcggtggcacgggccgaaatgcggaatcccggtgccgcttcgtttacagcctgatggtggaatgaattgacaggcaaggaggttgtcttcatgattcgtgccagcagactgccttcttctatccgtatggtatgggaggcgaaggcacggtccatgtcctgactgtgcttgatacgcgtaccttccatttgtacgtgaatgtcctgatagatgcttcccccaagtgctacgttcataatctgcattccccggcaaatgccaagtatcggaatctggcggttggcggcaaggcgggtaagaagcagctcctgacggtcgcggtaaggattgatgttgtgtaattcttttactggctcttcgtgcaggaacagtggatttatatctcctcctcctgtcagaagaagcccgtcgaggctgtcgagcaggcttatcattatgtcagtattttcgaatgggggtataatgaacggaatgcctcccgctttcagaatggaagtataatatccgggagcaagcgttaagtttccgtcactgaaattaccggtaattccgatgaccggcgcatctttatgattgggaaatcggttgtggagtacgttgtagtccgcttcgatgtcaaatgtttgaaacgttttcataagttaatatttcgtagaaaccgaacaaatatagagataaattcagatttatttttcatatttgctaaaaatctaatggtatggaattgattcgaacccttacccagttggtgaataatctgcgttcgcttggtatccgccggcgggttgctgtggtatgtcccaatgaccctcatacggaatacgttattattcgtagcttgcgtgaagaaatagcagaatatctcttggtcaccgatgaggcgcatgtggaggttgcacacagcttgcatgcggcttctcccgattttgtccgtatatatgttacttctactcccgacgaggcggccgcactggctgttgaactggtacgtacaggcgaggcagatattctgatgaagggactcattaataccgacaatctgttgcgtgctgtattgaagaaagaaaaaggcttgttgcccccgggaaatattctgagtcatgtggctattgcacagattccgctgtatcataaactgctgttgttttcggatgcggccgtcataccccgtccgggtttggcgcagtttcgggcgatgatagcgaatgatattgccttgtgccgtaagctgggcaacgacgaacctcgtgtggcactgatacattgttcggaaaaggtaaacgaaaagtttcctcacacgctggattatgtgcagctgaaagaagaggcacgtgccggcaagtttggtgctgcgtttatcgacggaccgatggacgcgaagactgcttgcgaccgtcatagcggagagataaaaggactgagttcgccggtggtaggaaatgccgatatcatgattttcccgaatattgaatcgggtaatactttttataaaaccctctcgctgtttggagatgcgaacatggcaggcatgcttacgggtaccgttgctccggtagtggtaccttcgcgcagcgattcaggaaattccaagttctatagcctggcactggcgtgtctggctggtacccaaaacgattaatatggaccttatatgaaaatactagtgatcaaccccggctctacttctacgaagctggcagtatacgaagatgataaacaggtgtggcggcagagtgtgttccacgcagctaaagatttatcagtctttcaccacatcaatgaacaatatgactatcgtcgtcagcatgtgacggaagcgttgcagcaggcaggtatacctttgcacttcgatgccatcattgcacgcggtggcttgctgaagcctactccgggaggggtgtaccggataaatgaacgtatcaagcacgacttatggcatgccgatatggagcatgcctcgaatctggctgctctgatagccgacgaactggctgcttcggcaggatgtccggctttcatcgccgatccggtggtgactgatgagttatgtgacgtggctcgtctgaccggtattccggagattcctcgtatttctatttttcatgctttgaacagcagggcggtttcccgcaattatgcggcacggattggcaagaagtatgaagagctcaacctgattgtggttcatttaggtggaggtatttcggtcagtgcgcatcatcacggaaaggtgattgacgtgaacaatgccttgaatggcgagggaccgttcagtccggagcgtgcgggaactattccggcacggcagcttgtcgacttgtgcttcagcggaaagtatacgtatcaggaaattcgtaagatgctgaatggcaggggaggtttgctggctcatctggggacgacggatgttcctaccatcgtgcggtgggcacatgccggcgataaaaaacataagctggtactggaagccatgatttatacggttgccaagcaggtaggggccatgcatgtcgctttacacggacagacggatgccgttattctgacaggaggcattgccaataatacttattgcgtgtctttgctcagagattggctggaaggaatagcacgtattgttgtcattccgggtgaggatgagatgggagcacttgccatgaatgcgctgggtgccttgaaaggagaattgcctctgcaagaatataatccgtaaaagggtataaaaaagcaccgcttccaacggtctgtgtcgaatgtataatcgataagctcgttggaagcggcgtaaaaggtatttcttgtcaaggagattgttccgtatcaagattcgtattcgtgcttgcgcttaggattcattgggaaccatcctttcaaaacccgttcacgttgttcgaatatctcttttattgtccaaaaggaagaaaaggaaaatacgcccaataaggtagaaatcactaggttgcttacaagtagtgaaccaatgattcccgctatacccaatagcaggaaccaccaccagcagcgcgttccccaataatattcggctttaaccactatcggatgaaacaacccgataatcaggaaggtacatatacctattataatcccttcaaaatgaaaagttgaaagccattccatctgtcagttatttgcggataggaatttcctttttgatactctgttccagtgaaattaatgtttccgttgcagttacgccgggaatttcctgtatcttagagttcagcaactccatcaggtgctcgttatctgttgagtatagttttgtcaacatggtgtacggccctgtagtaaagtggcattctacgatttcaggaattttttccagttctgctaccacgcttttatacatggaacctttttccagtttaatacccacgtatgtacaagtactgtatcccaaacttttggggtttacgtgatagcctgagccgataatgactcccaagtctatcagtcgctgtacacgttggtgaatggctgcgcgagaaactccgcaatcagcggcaacgtctttaaatggaatacgagcattctgggaaataatttccagaatctgtttgtctaggttatcaattttttccatataagcaatctatattatcattttgtaagcaaatataggaaaacttttttataagtcttatagatgtcaatgaaaaacatattttttttactgaaaagaacaaaaaagactccctatgggcatataagccctttgatttctgctattttgcgccttctgtcgaaggaaaaggtatcactatgcgtgtccagataattcatcagatacagtactttctgatataacgtttttctctcctcggccgactgctggatagatgcatcataacttagcaagtcggaaagcatctctatacggtgcagaaactcttgttccggaaattcggtttgtaagtaatgaaggatgtattcggcatcttgttcgtagaagaaactttcaggctggcggaaataagctcggtacatgctgtaaacttccactcgcagagttgctactggcttggtttctttttcttctttcagcttttccaatgcttcaaaaaactgcctgatcagtcgcatgatataatctcgttctaacataacctgttctttttaataggatgattgactggcaaagataggtagtttttctatatgctcattgtgtattcttgcccgaagcacagaatccggctcgaaatgagccttgtagtggtgtttttttgtgttaactttccccgttgtgttttcatttcttctatctttgtggagttaaatattataaatcttttaagacatgcacccgctggatttgtttaaatattgtcccaagtgcggatcttctcatttcgaaatacgaaacgagaaggctaagaagtgcgccgactgcggttttacttattattttaattcgagtgccgctacggtggcttttattttaaatgctaagaatgaacttctggtatgccgcagaggcaaggaacctgcaaaaggtacactcgacctctcgggaggctttatcgatatgggagaaaccggagaagaaggggtggctcgcgaagtacgggaggaaaccggattgcaggtggtacaggctacttacttgttttcacttccgaatacgtatttgtattcgggctttctggtacatacgctcgatttgttctttctttgccgggtggcagacgacagtcgtttgctggcaatggatgatgtggctgattcgttctggatgcctttggatcagataaaaccggaagagtttggactcgattctgtacgtaagggcgtcgctcgtttcctggaagagcataaagataaataagtacaataaatattctatcaagatatagatatgaagaacaagaaacatgtatgggtggcaggagccatgtgtgtgttgccttttatggcgatggcgcaacaggtggagccactgaccgattcccgccgtctttttgatgacggcaaggagttatttcttcgtcgtgattatgcggcggcgtggcagactttgtcgcgctatgtgcagcagaaaccgcaggcttcgctggccgatgaggctgcttatatgcttgcttgcacgtcgtatgaactgaaatctcccgactgcattcagcagctggaacattatctggaacaatatcccgagtcccgttatgccaacagggtgcacgctctcattgcttcagcctatttctttcagggacagtatccggaggctatcgctacttttaaggcgtgtcagttcgacttgctggcagatgcagagcgtgatgcctgtactttgcgtatgggtacagcttatttaaagatgggaaacttgcaggaagccgctgtgtggtttaatatactgaaagaggtgagcagtgagtatcataccgatgccgtttactatctggcatatattgattacgtacagaaacggtataacgaagctttgcaaggcttccgtgaggcaggaacaacgcccaaatatgcaccgctggctccttattatattgccgatatttatctgattggaggtaattatcagcaggcacgacagattgcttcgacttacctggaggcttatcctcgccaggagaaaacggttgagatgaaacgtatttacggagaggcatgttacggactgaaagagtacgacggtgccatccgttatttatcggcttaccagaatgaggcggaagccggggtaaaccgtaatgcgttgtataaactgggtatgagttatttcaatacgggagtttattcagaggctgctgctacgctgggcgaagctactacccggcaggatgcgttgactcagaatgcctatttgcacatgggacttgcttacttgcagctgaaagatagaagtcgggcacgaatggctttcgagcaggcttctgccatgaattacgaccgcagtatcaaggagcaggcgttctataactatgccttgtgtatacatgaaacctcttattctccttttgcggaatcagtaacggtattcgaacgttttctgaatgagttcccgaattctgcctatacggaaaaggtgaacgattacttgatagaggtttatatgaatacacgcagctacatggctgccttgaattcgatagcgaaaatcagtcatccgggaactcgtattctggaggctaagcagaagttgttgttccgtctgggaacgcaggctttcgcgcaggctgcttttgaaaatgccatcgactatttttctcagtcgcttcaactggggcgttataaccaacagacacaggcggatgcttattattggcggggtgaatccaaatatcgtctggagcaatacgatgctgctgcatccgactatcgtcagttcttggaatttgctcccgaccgaagcagtacagagtacgcgctggctttgtataatctgggctatacggcatttaaacaaaaacagtatgataaggcactgacttggtttactcgttgcgcggaatcgggtatccggctggagaacgatgtggtggcagatgtttataaccgaatgggtgactgtaacttctatgcacgacgctttgatgcggccgatgctcagtatgctcaggcatccggctattctatgccgctgtcggactactcgttgtttcagcagagtattatcaaaggcttgcagcgtgagtatactcagaagatcgaactgttgaaccgtctgatttccggattcccaacatcgcaatacatagacgatgcattgtatgaacagggacgtgcttttgtacagatggaagataatgcgaatgccatcaagcgttattctttgctggtacagcgttatccggaaagtccgttgtcgcgtcgtgctgccaatgaaatcggtctgctgtattatcaggatgataaatacaatgaggcgatagctgcttataagaaggttatttctacttatccgggaagtgaggaagctcgtctggcgcagcgtgacttgaaatcgatttatattgacttgaaccgggtagacgattacatggcatttgcttctactattccgggtggtgccaatttcgatgtaaacgaacgtgattccttgacgtatgtggctgccgaacgtgtatacatgcgtggcaatattgccgaagcaaagtccagcttcgtccgctacttgcaatcgttcccgcagggagcattcagtgtcaatgcacattattacctgggattgatagactataatgagaagaattatacgggcgcggcttctcatctggataaggtaattgcttatcccgacaataagttctcgggtgaagcgatggcgatgtgtgccgatatggcttataaggataaagcatatgaaaaggcattgggactttataagcagatggcagaccgggctgcttcgcaggaagaacgggtacaggctcgtacgggtgccatgcgcagcgcttggatgataaaagattatcaggaaattgttgcggtagcttcgggactgcttgccgaaagcaaactgactccggaactgaagaatgaggcttattattatcgggcaaaggccttgctggccgaaggacagtcgaaagaggctgtgaatgatttgagcgttctgtcaaaagatactcgtaatgtatatggagctgaagctaaatatttgctggcgcagctttatttcgatgcgggacagacagataaagccgagaaggaagtactcgattacattgaggtcagtacgccccatgcttattggctggcaagaagtttcgtcctgctgtcggatgtatatatgaaacttggacgtaacctggatgccaagcaatatttgttgtcattgcagcagaactatcaggcggacgatgacattgcgggcatgatagaaactcgattggcaaaacttaataagggaagtaaacaatgaaacatatatctgctattataatgggagtggcgctgctgcctgtagtaaaaggttatgcacaggagcaggctaaagattctacattgaaccgtacagtggtggtggagaatcaatacaaccccgaagtgatggatgcctttaaggtaaacgtattgccaaaagtggaggagcctgctgtggcaaaacaacatatcgactatgctacttcggtacgtccgctcacgacgtggagcttttcgccgatggctccgattaccagtgaacagaaacagccggatgctcctcgggggtatatcagaggtgcttatggcagccggaacaataccgacctgaaggcatcgtatctgtgggatatttcccgtcgtgaccgtttgcagttcatgggttccttgtatggtatgtatggcaacatttcttctttagtacccgatgagggggattggaaatctcgcttttaccgtacggatgtatcgttggactacaaacatgatttccagaaggtttcactctttttgggcggagcttttacttcacaggttttcaattacatgcctggaatggagaaggaagttcagaacatgtacgaaactaccagacagcattatacgctgggagaagggtatgtgggagtggcttctgtagaaggtaagcttccggtagagttttctatacagacaggcttgcgcagctttagccgtaagtatgatattccttacatgcgacatggatcggaaaatatatcccatacggttggatttatatctggtgcattgaatgacgaacaacgggtaggagtcggacttagcatggataacctggcttataatgtagaacagaaagactatacgttgttgaggctgaatccttattatacgctggaaaatgatgatatacgtctgcgtgtaggagcgcatgtcgactggcagtcggccaatggaagtggtatcaaggctgctccggatgtaaaggtcgactatacatttgccgatgcttataccgtatacctgcatgcgacaggaggtactcagcttaatgacttccgtcagttgaatgagatttctccttactgggggcaaattagccagatgcgcacatcgtatacgccagccgatatacaggccggattcaaagcttctccggtaccgggactgggctttcacttgtttggcggctatcgcattacaaaggatgaaatctttcagccgggtgtcatagtagacagtttcccctactgctattctctgttgtcgcaggaaaaagcgaaagtgggctatggaggagcgaaagtggcttatggatataaagatcttttcgacttttctgtcaaaggaacttattatagctggaatgtaaaagatgaggcaaagatgcttctttatctgaagcctcagtttgtactggaagcttctgcacgtgcgaatgtatacgacaaattctggatttcggcagattatcgttatgaaggacgtgccaaggcgggtgaactgaagaaagcggatgcgataaacaatctttcgctgtcggctggttatgagttctttaaccgtctgaatgtttttgtacgtttcgacaatgtactgaaccggcattatattactcaggcaggttatccttcacagggattcaatgtgctggctggagtaagtttccggttctgatagctgtatactcaaagagaagcctgtagcgaatttacgttcgttgcaggctttttttatggtaggctgtgaaaatcgtttcgaggtaaatgtattctctttttcgtattttgtgagttgtatactctaaaaaaggaagaattttagaaaaacgcaccttattatatggtgtacttcaggttttttcatacatttgtcccaaaatcactaaatggattacagaaattatgcaaaataatctggtaatagttgagtcccccgcaaaggcaaaaactattgaaaagttcttgggagagggatataaggtactttcaagttacggacatatccgcgatttgaaacagaaggcgttcagtatcgatatcaagaatcatttcgccccgatatacgaagtgccggaagacaagaagaaactggtaactgaattgaaaaaggaagcgaaaaaggccgatatggtatggctcgcatccgatgaggaccgtgaaggagaagctatatcgtggcatttgtttgaggtgctggaactcgacccggcaaagacaaagcgtattgtattccatgaaattaccaagactgctattctgaaagccattgaacatccgcgtgacattaatgtcgacttggtgaatgctcaacaggcgcgtcgtgtactcgaccgtattgtgggcttcgaactatcaccggtattgtggaagaaaatcaagccttctttgtcggctggacgtgtacagtcggtcgccgtgcgtttgattgtggagcgtgagcgtgaggtacatgcgtttgtaagtgaggcttcctataaggtcaccgctatttttaccgatgacaaaggagctgaaatcaaggctgatttaggaaagcgctttaaaaccaaggaggaggcaaaggcatttttggaaagttgcaagaatgctggattcaaaatagaagatattactactcgtccgataaagaaatcacccgctgctccgtttacaacttctaccttgcaacaggaagctgcgcgtaagttgggctataccgtggcacagaccatgatgctggcacagcggttgtatgagaacggacagattacttatatgcgtaccgactctgtaaacttgtcggatctggcactgagtacgagccgcgataccatcctttcactgatgggtgaaaaatatgtgcatacgcgtcattttacaacgaaaacgaagggtgctcaggaagcgcatgaagctatccgtccgacttatatgtcgaatgaaaccattgagggaacttctcaggaaaaacgtttgtatgacttgatctggaaacgtaccttggcttcacagatggcggatgctgaactggaaaagacgactgctaccattgcaatcagcggacataccgataaatttattgcagtaggtgaagtggttaccttcgacggtttcttgcgtgtgtacaaggaatctttcgatgaggatatggagcaggaagatgaaagtcgtctgcttcctgctttggaagtcggacagtcgctcgattgtaaggaaatcattgcaatggaacgttttacacaagctcctccgcgctatacggaagccagtctggttcgtaaactggaagaactgggtatcggacgtccttctacgtatgctcctacaatttcgactattcaacagcgaggctatgtagagaaaggaaatcgtgaaggcgtagaacgtagttatgaaatcctgcaactgaagggaaataagattacagaaagtacgaaaacagaaataaccggaagtgaaaaggcaaaactgattcctacggatgtgggtattgtggtcaatgacttcctgaaagaatatttcccgcagattatggattataacttcacggcaagtgtggagaaggagtttgatgaaattgcagaaggagataaaaaatggacggatgtgatggaacatttttatgaaggtttccatccgttggtggaagatacgatggctgccaagtcagaacataaggtaggagaacgtatgctgggggtagacccggtaagcggaaagcctgtttctgtgaaaatcggacgctatggaccggttgtgcagattggtacggcagacgatgaagaaaaacctcgtttcgctcagctgaagaaagaatattcgctggaaaccattacattggaagaagcactcgatctgttcaaacttcctcgtacactgggcgaatgggaaggagctgttgtaacggtgggaacaggacgtttcggatcatatatacgttataacaatacgttcgtttctatacctaagagtatggatccgatggctgtcacgctggaggaagcgataacgttgattcgtgaaaagcaggatgcagcagccaaaaaggttatcaagacttttgatgccgatccggatatgcagattttgaatggccgttacggaccgtatatcgcatatcagaaaaagaattataagattcctgaaaatgtggaggcggccgatttgacattggatgcttgttttaaggtcatcgaattgcaaaaggaaaaggctgaggtgcgtaaagttcgcggcggcataaagaagaaataatgaaaagaatctttttgataggttatatgggatcgggcaagaccacactgggtaaggcgtttgcccgagccatgcaactccagttcattgatttggactggtatatcgaggagcgttttcacaaaacggtgcaggagttgtttgccgaacggggagaagaaggctttcgtgaggtggaaagaaacatgttgcacgaggctggagagtttgaaaacgtcgtgattgcagctggaggaggtacaccctgctttttcgataatatagattatatgaatcgtgtgggtgataccgtttttctggatgtcagtcctgaagtcttgttccgtcggttgaaaatagccaaagcaaagcgtccgctgctggctgataagacagatgaggaactgatggatgtcataaaagcagccttgcagaaacgtttaggtttctacatgcaggctaaatataaattcaatgccgagaggctggaaagtcataaacagatcggcgaatcagtagagcaactgaaattattattagataaatagattataaacgtagactttatgttgtgaaatgagaaaatggcgtattgaagattctgaagaactctacaacattactgggtggggtgtttcatactttggtattaatgacaagggtcatgtagtggtaactccgcgtaaagacggtgtagccgtcgacttgaaggaactggttgatgaacttcagctgagggatgtcacagctccgatgctggtccgtttcccagatattctggataaccgtattgaaaagatatccaactgctttgctatcgcttctgaagaatatggatatcaggctcaaaactttattatttatccgattaaggtgaaccagatgcggccggttgtcgaggaaatcatcagtcatgggaaaaaattcaacttaggattggaagctggttcaaaacctgaattgcatgccgttattgccattaatacggattctgattcgctgatcatttgtaacggatataaggatgaaagttatatcgaactggccttgctggcacagaaaatgggtaagcgcatttttctggtggttgaaaagttgaacgaacttcgtctgattgccaagattgccaaacagttgaatgtgcggcctaatatcggtatccgcatcaagctggcttcttcgggaagtggtaaatgggaagaaagtggaggtgatgccagtaagttcggtctgacttctagtgaattgcttgaagcactcgattttatcgaaaagaaagagctgaaggattgccttaaactgattcatttccatatcggaagtcaggttaccaagattcgccgtattaagacagctttgcgcgaggcttctcagttttatgtacagttgcatcaattaggtttcccggttgagtttgtggatataggtggcggattgggggttgactacgatggtacgcgttcttcatatagtgaaagcagcgtgaactattccattcaggaatatgtaaacgattctatttctatcatggtggatgccagcaacaagaacaacattccacatccgaatatcataaccgaaagcggacgttcgctgactgcccatcattcggtcttgatttttgaagtacttgaaacagcttctttgccggaaatggatgaggacttcgaagtaagtcccaatgaccatgagctggtacaggaaatgtatcagatatgggataatctgaatcagagtcgtatgctggaggcatggcacgatgcacagcagattcgtgaggaaacattggatttgtttagccatggcattgtcgacttgaagacccgtgcgcagattgaacggttgtactggtcggtttgccgcgaaatcaatcatatcgtatcgggattgaaacatgctcccgatgaattccgcaacttggacaagctgctggcagataagtatttctgtaatttctctctgttccagtcgttgccggactcatgggcgatagaccagattttcccgattatgcctatccagcgtttggatgagcgtccggaccgtacggctacattacaggatattacctgcgactcggatggaaagattgcaaatttcgtgtctacgcgaaatgtatcacacgacttgccggtacatactgttaaggcaaaagaatcttattatatcggtgtgtttctggtaggagcttatcaggagattctgggcgatatgcataatttgtttggtgataccaatgctgtgcatgttactgtcaatgagaaaggatacacaatcgatcaggtgattgacggtgagactgtagcagaagtactggattatgtacaatataatccgaagaaactcgttcgtacgctcgaaacatgggttactaagtctgtgaaagagggtaagatttcattggaagaaggaaaagaattcctggcaaattatcgttccgggttatacggatatacatatttggaataatacaaaataagcatacaatgaaagagaaactgactattgtaaaagtaggtggaaaaattgtggaggaagctgctacactgaaccagttgctttccgatttttcggcgataccgggttataagctgctggtacacggcggcggacgttcggctacaaaaattgcggcacagttgggtatcgaaagtaaaatggtagatggacgccgtattaccgatgctgaaacattgaaagtagtcacaatggtctacggcggactggtcaacaagaatattgtagccggccttcaggcgaaaggtgtaaatgctattggactgacgggggctgatatggatgtgatccgttcggtaaaacgtcccgttaaggaagtcgattatggtttcgttggagatgtaaagcatgttaatgctgaggtacttgtatccctgattagccagggagtcgttcctgtcatggctccgctcacccacgatggtgaagggaatatgcttaacaccaatgctgatacgatagcgggtgaaacagcaaaggctcttgccgaagcatttgatgttaccttgatttattgtttcgaaaagaagggagttttgcgtgacgcagacgatgatgaaagcgtcattccggttatcactccagatctttttcagaaatatgtagccgaagggatcatacaaggcggtatgattccgaagctggaaaattctttttcagctgtagaggccggggtctcccaagttgtaataaccttagcatcagctatcgacggtaagtcgggcacgattataaaaaaataattcaaaaaaataggcgggtgggtgtaacttttgtgtaactcacccgtcattattatagaaagcaatgcgagaaattagtttccgaaatgatattttgccactgaaagacaaactttacaggctggcactccggattactttcgatagtgccgaagcggaggatatcgtgcaggatactatgatcagggtatggaacaggcgggatgaatggtcacagttcgattcgattgaagcctattgtctgacagtggcgagaaatcttgcaatcgaccgaagccagaagcaggaagcacagaacatggagctgactcccgaaacacaggaaatgcctgacgcattgacacccgataaaaagtatgagcaggacgaacaacttaagctggtacatcgtttaataaacgagctcccggaaaagcaacggactatcgtacaacttcgggatatagaagggaaaagttataaagaaattgccgatgtcttacaactgacggaggaacaggtaaaggtgaatctgtttagggcaaggcaacggattaaattaaaatatagcgagatagacaactatggactataagtacattgaacaacttttagaaaagtactggaactgcgaaacttccatagaagaggaacagattctgcgttctttcttccaccagaaagaagttccggcacatttgcttcgttataagcctttattcgcttatcaggaagcagagaaagaggtaaagttgggtgatgactttgattcacgtattctggctgagatagaaagaccggtagtgaaggctagacgccttactttacatacacgctttatgcctttgtttaaggcagctgctgtgatggctcttttgtttacggtaggcggagtggtgaaacattccatggatggaaacaaagcgggagttgtgtatgtttacgatcagtttgagaataacacgcacgatccgcaggtagcttataaagtggattcggtcaaggcaccgatgaaggtttcagagcaacctgttgtagagaaacaataaattgacattttcatttgcttttatataaatagttagtgcttatttaagaaaaatcattgatgaggctgtgaagtttcaattctctcacattaaaatttactaactcaataaaaaaggattaccgcgtgagcagtaatccttttcttgtgatactcactaatagtatgaaatgaacgatgaatgtccttattcgataatttcaccgttttcggtaaacaatacgttggcttctgcaccttccgcgtctacgagggttataagataacgtgagttcgatataaagattaaaattatcagtttgaaaattaggaacatagcgataaaagcattaaatttatagtgtctaagtataacatttaagcgattaccactatgttctcagagtctaaagttacggagattttttgtatggcggatgatttttgcaaggaatttgccaaaacacaggaaaaatatatggttgaagaaaagaatcataagcatcggaacaagccgaaccggatgagtgatgcggaaatcatggtcatcttgatcctgttccactcgggaggcttcagatgtttcaagcattactacaaagaatatgtatgcaaacatctgacgcatctctttcccagacgtgtgtcctataaccgttttgtggaactggaaaaggaagtcctgttgcagctgaccattttcatcaaggaagtcctgttgggtacctgcaccggtatcagctttgtggattccaccccgctgcgtgtatgccggaaccaacgcatattgattcacaagacttttaagggtctcgccgaacgtggaaaatgctccatgggatggttcttcgggtttaagcttcacctgatcatcaacgataagggtgaaatcctcaatttcatgttcactccgggaaatgtggatgaccgtgaaccgctgaaacagacaaagttcctgaagaatataaaagggaaactctgtgcggacaaggggtatgtcgggcaaaccctgttcgagaacctgttccttaacggcatacagttgataaccaaagtgaagaacaacatgaagaactccctgatgaacgtggcggacaaaatcctgctgagaaaacgtgctttgattgaaacagtcaatgacgagttaaagaacatcgcccagattgaacactccagacaccgttccttcaataactttattgccaactcgctctctgccatagctgcatactgcttctttgaaaagaagcccgccattgacgtttgttttgtcaaagacggacaactcacgatgttttaatttatttcgaactcacgttaagataagtttttactccgtcttcgtcttcctgataggctgcacttttaacggtgtattcactgaggtttttggccaaggtatcttgtatagcttggggcaaatctttaattgcaataggtgtgtaatcagatgcactcaattcgataggagttacgttagttgtactggttgctgcaaatgatacagatgttcctaaactcgctactaatgctattgctactaaaatctttttcataatggttgttttttatagttatacaaatgtttctgtaaatgtaaggacaagcggtgtgccaaaaaataagttttctataagttattgattatcttttaaatatatacattttgtttttgctggtgttatgatgtatgaggaattattcctcgaatttgtagagctgggtatgtgaaagacacgaaaaatctacagcaaaaaggttaagtgagtgtttggtatgggtagataggaatgaatgttttctgttaaagttaattgggaaaagaaggttacggcagaggagatatacggttttttatgtaagtttgctgtatgataagcaaaaaacagataatttccgataaagatttcgggcagatacattttacagtccgtcgttcggcacgcaatattacgatgcgggtaaaagaagatggattgcatgttaccactcctccttaccggagcgtgacggctttactcaacgccattgcgccttttcgagaaaaattgcttcatgcttgtgcggaaatcaagccaaaaccattcgacttaaactttacgatcgaagccgaatgctttcggttaaggctggaaccttctcccttgaaaaatttcacggtgagtctgaaggatgaaactgtcgtgatagcttgtcccgttactgccgattttacaacgaagagagtacagaccctggtgaaaaatgctgtaatgcgagccatgaggaagaaggcagaagaatatcttcctccattagtacagtactggtcccgtcagtttgagctgccttatcataaggtgagtatttcgaaagctcgttcccgctggggaagctgctcttcgaagaaagatatcagtctgtcgttttacctgatgcttttgccggcacatttaatggattatgttattttacatgagctagcacatacccgtgagatgaatcacggtccgaggttttgggacttattgaatcggatgaccgatggaaaggcattgacgttgcgcaaggagttgcgtacctatcggccggctttttaaaggagtaatgtataaaaaattgcttttcgcgatgacaacgaaacagaaaaggttgtatattcgcggcggataaggaaagatgccagagtgaccgaatgggccggactcgaaatccggtgaacggctttgtccgttccgtgggtttgaatcccactctttccgcttttatgattcgatagtatattcccttgtatttttgttatatgaaagaggttgtatatgcagcttgttttcattccttcgtttttccctgattttcaaagacaggaaggagttctttgtgctatggcttttcggttgctttatgacttgataaaaaagaggttatcccgtcctgatagttgggaaaacctcttagtcaaaagcgcttacacttattattttattctgttcttaaattattgattggattactgcgtgctgccttccatatcatagaagtgctgagaatcaacaagattatgagtactaccaggatacatcctccgaagatatatcctgtgaggttgattttgaacgcaaacaattccaataggcggttgctggcaaatagtgcaaatgcggttccaatcagaacagcaggaatggctattttcagaatatccttcaagaagatgagttgtacatcctttacttgtgctccgtgaatgatacggatagctatttccgaacgtcggcggtttacttcatcacggatataggctatcagtccgataagtgcaattaccagaatacatagtccgacaaagagtatactgtttcttacgtgtaacagcatgttgtactgattagccatttccaagtcgaggctatatacttgtttttcctggctgggcatggtgcggctgactatgtcttgtatctcctttatttgttctggacccatttctttcaaacgaatgtaaagaagatggttaggatgcgtgttgtagaacatcaccgttgggcgatcgtcgaaatcttccgctacttgagaacccagatgaatttcttcgtacacaccacagatagtataaggacgaccttgatgctctgtgataaagatttgcttaccaataggagaacctgtccatccggcgagtttttccatcttgtcgatgaagctacggctcaccattacttcctgactgacactatctcccagttcggtggtaaagcccgttccttccaaaatggggatactgaatactttatgatagtcggggcctacatcatacatatcggcaatattcatgtattccttatcgttttgtgggtcgtatacattgtttccgctgcatttcataaacatttcctgatatccccaggttactccgtttacattaggaagcctttttagttcttgtatgcaacgttcacgttctacgttctgcgttccggatagagaagtataaagtatattcttatattcgaatccggtgcgataattggtcaatgcctgatactgaagtccgataacggtaagcaggcagacaaagaaagtagttagcatgaactgtacaaataagagtcccaacttccattgtcgtttgttctccgtatatcgacgataggcgtaagtgacaggtatgcgtgtatatatatagccgggcattactccgcaaattacagcaacagcaataacgaccattaggcacagcactaaagctgtgggagaaaataaggctcgcaaactatgtcccatttgttcttgcagaaaatcttgcagaccgaaaacaatgagtacggcaagtatcagagcaatgaagcagtgcaatgccgattctgccagtatcatacgataaatatccttgctttctgctccgtaacagcggtaagtagcaatacttttggctcgtttcactaccgatgaaacaaccagtaggatatagttcaggacagctactgccagcatgataaaggcaaagatgaggaatacgatgttcatgatacggttgtattccgaggatagaaagatcttgcttacaggtttcaggttcaggtaaaactggctgcccgaacgttccagctcttccatcggagcattggtgtacagcatgtgcttgatgttaggttccagcgtttgcggatctgtaccgggccgcaggcggatatatccggaataacggtcgttccccagccaattgtttcttccgtctcccattatttggccaatggtaggcaaagctacagcaatatctattttcggcaaatgagtattttctgggaaatcctcaaagactcctactaccgtcagatgaaaatccgggaaaattttccaagtcagttgtttgcctataatatcatttcccagtactttcagcagtttggctgatatataagcattgttggctttttccagtccggtatgaggcgcttctcccattaagatttttcgtggaaagacctcgaaaaaagaactgtcgcacaaataagcattaccttttatggtacgttggtcatcggttgttaacagcagatcttcattcaatatggtaaaacgagtggcggcttctacttccggacaatatcgtttgatacccggggcaatagctcccgatacggtgttgtgatttttccagtcattaccttgatgcttataattttcctgtatgatataggtatcttccagatggggaataaagttatcatacgaccgttcgaaaattacttcggcaagcattaccagtccgatagccattcccacacccagacagagaatttttgttaggtcaccttctccttttcggaaaagattctgtagggctcttttcatcattcgcttggattgaagttaaagtaagaaggcacatccagctatattgccggtatacctccttacatataaagaaaacttaagagagattacatttcactgatagaggatacaatctgcccgtcgaacagattgattacacgtccggcaaatccggcatcacgctggctgtgggttaccattacgatggtagttccttctttgttcagttcggtaagcaactccattacttccagaccgtttttagaatccaagttaccggtcggctcatcggcgaggatgattttcggattggaaactacggcacgggcgatggccacacgctgctgctgacctccggagagctgctggggataatgtttggcacggtgactgatattcatacgcgacagcatttcggttacgcgttttttacgctcttcagcagaaatattcaaatacgtaagcggaagctcgacattctcgaaaacattcagttcgtctatcaggttaaagctctgaaatacgaaaccgatattacctttacgtacattggtacggtctttctccttcagatgtccgacctctttgttgtccagataatagttgcccgaggtgggattatccaataagccgaggatattcagtaaggttgattttccacaaccggaaggtcccataatggccacgaattctttttcattgacttccaggtttacattgttcaaggcaattgtttctacttccgttgtacggaatgtcttgcaaaggttttcaatcttaatcatagtgataagtattaaattgttattatattattcttttgtttattattctgcttttaagttgtctgtcggattgctgatggccgttcggtaattctgtactgtaatcgttatcagtgtgatgaggctgatgacgatacaggtcagaatgaatacccacggcgtgatggctatccgttcagtaaactgttccagccatttagatacgatataccaggctatcggtgtcgcgatgacggaactgactaccgacagcgtaagatatgatcgtccgaacatccagagaatctgacgggtataggctccatatacctttcggataccgatttcctttcggcgctgttctgcttcgaagataaccagtccaaagactcctaccagtgaaatcagaatggcaagcagactggacagcgtaatcaactgttgctgatcggcttctttctggtagagctgactatatacttggtcatagaattttatatcgacgggataaccgacaaaacatttggcaatggtttgacggatgtgcttcaaggctgtttccatattgcttccggcttttacacgaatgtaggcaaaaggcaggatatcgctgccgtatttcccgtttggacagaatatatagggaagtgcttcagaacggagcgaggttaattgtacgttgttgacgtagccttttagtcgcgcattcacaccccagacgaagaagtccagtatttcaccggccggaatgccggtttgttgctgtaagtcttgtgtggcaataaagttcagatcactgtgatagatggagtcgctggggaggaaatcttctcccgatacaatttttaagcccattaccttacagaagtttgtcgtgacatcgatgtagtaatgtccgtgcacttctcctttatataagaaggcatattgagtatatccgcctcctccgcccagacttgatttagcataggcgatatcatctattcctgcaaaactttttagggcatttgtaaagttgcggtattcggaactttgataaggcatttgtgggagagaagcaaccagtatctggtctttgtcaatgcctgatgtataattttgcatatagcggttttgcagaaaaatgaatccggcagttacaatcagcacaaatgaaatgatgtattggaaaccgataagtgacatgcggagccgtttgcctcttccgcttagcgcatagttccctttcagcacgagggcaggagagaacgaagtcatgtaccatgacggatagagtccggcaatgatacctgttaccagtgcaatgattccggtatacccgatgatgtgccagtaggtaatcagtgaaggggtgaatcccataaaagacaatgccttcaggcgtatgagtatttcgacaatgcccagtgatacgagccagcttatcaggacggtaccgacagattctgttaataaggcacggcgtagttcccagttgctgctgcccaatactttttgtgtattgatactgcgtatgcgaaccggagctaaggctgtactgaagttgatcaggttgatgcaggcgataatgataatcagtaatccgatacttacaatcaataccattgtactacggtcccctgtcttgaggtaataggatgccgacatatcgtaataaagcttcttgatggggaatacgtagagtcgttgatttcctttgtctacaatattcagtcgcttgttggcgccgctggcttctatttgctggttgatatcggctgcactaactcccggtttcaaccggaaaaaggcaaaatagttctggcttgcccagtcatctttttggtaatcactcatccggatgaacatatcatttttaaactggcagttctcagggaggtctttaaagataccacatattctgaacttatctattccctttaccagcccattgtcgccttccgtatagagataggagcccagggcgttgcctttagggaaaagtttgcgggcatagctttccgaaataatgatactttcaggtttattcatgtccttgtcactgccttctacgaactgcaatccgataacttttgcgaaatcggggtatacggcccacggggtttcatagaaatattgcggactttcaggattggtgcagaatgcctgtttctgccagcagggagcatagatagtcccgtattcaatgccgggtatctgctcgatgaggaaatcaatcggtcctcgtggaagagccatgatggagttatctttctcttctcccaaatttagtccgaccaggcggtcggggttgggataacaagtatcgaagctatattcgtaacttgctttcatcataatcagtatgaaagccgcaaaggcagtcgacagtcctaataagttgagtacggaagctgtccgaaagcgcttgagtgtatagaacaggttacgtagtattgttttcataatgttgtaatgtttattctgtctttaagttttttatagggttttcgcgagtagcattccggctgatcagataaacagaaccgagcgatatggcagttacggtaataaaggcgatgattccgctcaaccagggcatggtactttgataatgggttatccggttgatttgcatgatgccgatgtaggctagcggaagtgcaattataatactgataaccaaagaactgaatgcgaattgtatcagtcgcttcatttcttgtctgctgctcgatccaaatactttacggatagccatatcgcgtttgcgttgtgctatgaaatatagactcatggcagttagcccgagcaaagaaatcagcagggcggcaccggtaaagattcctatcgtatgctgtaaattggtcaggtctttgtatatcgcttttacctgattgtgataccattccgactcgaatgggatcccttctattgtttctgaatatagcttgtcgagctcttttttatagtaggttagctcgttgccagttacttctatcagaatattccacggatagatactgtccggatgcatgatggatagcatggtcgggtattgggtatccagtatggaaccggacttgatatccttgaatgttcctgctacaggataatgcatgcttcccatctggggactgcttcttagataatctgcgtcatggctgagacccaaggcattgaatacgctgtcggaaaagaaataggtcgtttcttccgtaaccggtagatggttgtttatgatgttcagatgaaacagatggatgaatgttgaatcggctgtcagatgtctccatcgtatgttttgtatttcttcttttccgttatatatctgtacggcattgttttctccctgaaggtcggcgggagttccttgtgtgaaacataccttgcttacaaatggcagtgtgcgggctttatcgcggaatgtctgcaacttctgtttattgaccagtgccggatagttgaggatattgccgtaactgtatcccagcggctcatgtaagatattatatagttggatacttaaatagattgcacacgtcagcatggcaagagtaagactgctttgaatgatgtataatccgcgtaaataaacgacttttgtcttgcgtcggaaattaccttttactatatccagcggattatatcgtgagagcagggttgccggaacaaagcctgcaaggagagagagcaggaggataccggccagataaatgctcagagtaagaatatttaaatcgccagtcaggtcaaggttcacttgtaacaagcccgaagcaaatggctcaacagctcttgccagtagaaaggcgaggagaaaagcgcctaatgtgagcaagaaagattctgcaatcatacgccagaagatatcggggcgtgaagaacccagcagtcttcgggtagccatttctttggcacgatagctggtttgggctacgctcatactgatataattgaagactgccatcagcagaatgagtattcctacgcagatgaagattactacttttgtaaaactgtattgcaggaaggtaccattcgatggaatttcactgaaatgaaaatcgtgcatggatacccattttacttccttcatatagccaagcgcatatatccagtaatacttcttcaaataatcgagcatttgtgcagctttatcattggaattagttccttcgtggaagcgggcaaaaacagttgcacctccggcattgttcatgttgcgttcatgcatactgctacttttgtcgatatagtcgatgaaatcgtatgggacaatcgcttctatatcactgggaaatagtgagttgtcgatgtttttcataatacctgttacggtatatgtttcttggctattggcggatagtcggagagcctttccgatagctggttcattgccaaaaagttttctcgccccgttttcggttagaacaatgctgtttttgtctgttaaaacctggtcgggacgtcctgatagtaatttgaaataaaagaactgaaagaaattgttgcgggatgccaaaatctttaattttacttttctggtttcttgtaagacgtagataccggtatatgccaaattgctaacggcacaccagtcttctatttccggatattgggtacttagtatttctcctaccagataatgtgagccgatgtattgttcattgccaaatgcataaatacgagaagcatggggctgctctttgtctatactcagttgtcggcttaccatgttggctattaacaacacgaacattagtgaaatgcttagtcctcccatattcacaagtgtgaacatcttgttcttattgagaaaagtaaaatatgttttgagtcctttcatctgtttattaatggtttgttcggttataatatagcaaagtgcgtgccattgttgcaatatattgataatcaggctgtatgtaaaataatacttagctggaggtgtctaataatttgacacatggtgtatgatttttagacactttaataaataaattagccgtttttgcccttcacgcccttcacatgaatggcgttcggtgtatatcatgacaaatgaatatctggaatttatcatgtcgataggaaaatattaatagtcgttagaggggttgttatctcagataagagcagtgacgatattatcggtgaagggtgtgaagggcaaaaacaggtgtttttctctttaaaaggtgcctgaactggtagaaacagcccttcacagtcctgttgaggtatgtttgtttttgctcctttctcggatttcgtaatagttcccggcagaagagggggctttttccctttttcgcataaaatttcatcatttttctgttccggaccgtactattacgcggtgtctcgaaaaatttctttcgtatttcctttggcttttcccgttactatctcatgtttttgtacaaaactttcaggaatttgtacaaaacaaaatattttttgtacaaaaaccggagaaaattccggcatgttttttcagcattttcgggatctttttatgcggattgcggatttttttgcttttttctcttgacttttccggtggaaaaatccgtttttttttaaatccgaccgtccgtcaatgacagaatttattcctatcggccgtatatctttcatgcttttttcggatgattcgataaatttttctgcttcttttcccgtgcatttctgtatttttccttccgcctacgaaaaatctgctgctttttccatccggatcatccgttttctgagattttttcgcttcgtcggaataatttttcttgccttttcccgagcgaaactgagaaatttttctgcccgtttcgatattttttgcgcttctcctgaattttttcaaaagaaaaatccgcttttttcagcatgaatttcccttgcggatgatccatttttcccttcctcggggagtatttccggatttttttcgtgtcatccgataaagaattccatccttccagaggtattttccgctccatccggcaggaattttcaccgttccggatctttttcgcacgaaccagactcgcgcgcacctgcacgcgcgtaataatatattgagtacccctcccggctccctttcccttattccggaaaacctgccgtaaaacatacctgaaacacagcattttatgaattttcttgcaaaaaaaattgaaaaaaagtgtgggtaaaagttggagaaagcgaaaaagtgcgtaattttgcacccgctttcgagagggaaagacgttgaagagatgacaatctgaaaggaaacggagcaggaagcagcggttctgaggcggtccaagtatcttaccttaacggcgttaagggagcgagaacggcagccggacggagtcaacttccgccgctaaaaaaactttttgaaaaaaactttcgaaaaagtttggcggtttcgaaaaaagctcctaactttgcaaacgctttcgacaacgaacggaagccacaaaaaaaggaaatagttctttgaaagactttagataaacaaacgaagatgtagtacaagaagtagctgtcatatataataatgtatatgcggtgaaaaagaaagaaccgtcaatatttgaacaaagtaaagacattcggttacctgaacagagacaaaagtactcgcaagagtaaaaagatattttacaatgaagagtttgatcctggctcaggatgaacgctagctacaggcttaacacatgcaagtcgaggggcagcatgaacttagcttgctaagtttgatggcgaccggcgcacgggtgagtaacacgtatccaacctcccgcttactcaggaatagcctttcgaaagaaagattaatgcctgatggtatcttaagcacacatgtaattaagattaaagatttatcggtaagcgatggggatgcgttccattaggtagtaggcggggtaacggcccacctagccgacgatggataggggttctgagaggaaggtcccccacattggaactgagacacggtccaaactcctacgggaggcagcagtgaggaatattggtcaatgggcgcgagcctgaaccagccaagtagcgtgaaggatgaaggtcctatggattgtaaacttcttttatacgggaataaagtggtccacgtgtgggcctttgcatgtaccgtatgaataagcatcggctaactccgtgccagcagccgcggtaatacggaggatgcgagcgttatccggatttattgggtttaaagggagcgcagacgggggattaagtcagttgtgaaagtttgcggctcaaccgtaaaattgcagttgatactggttcccttgagtgcagttgaggcaggcggaattcgtggtgtagcggtgaaatgcatagatatcacgaagaaccccgattgcgaaggcagcctgctaagctgtaactgacgttgaggctcgaaagtgtgggtatcaaacaggattagataccctggtagtccacacggtaaacgatggatactcgctgttggcgatatactgtcagcggccaagcgaaagcattaagtatcccacctggggagtacgccggcaacggtgaaactcaaaggaattgacgggggcccgcacaagcggaggaacatgtggtttaattcgatgatacgcgaggaaccttacccgggcttaaattgcagacgaattacttggaaacaggtaagccgcaaggcgtctgtgaaggtgctgcatggttgtcgtcagctcgtgccgtgaggtgtcggcttaagtgccataacgagcgcaaccctcgtggccagttactagcaggtaacgctgaggactctggccagactgccatcgtaagatgcgaggaaggtggggatgacgtcaaatcagcacggcccttacgtccggggctacacacgtgttacaatgggaggtacagaaggcagctacccggcgacgggatgccaatctccaaagcctctctcagttcggactggagtctgcaacccgactccacgaagctggattcgctagtaatcgcgcatcagccacggcgcggtgaatacgttcccgggccttgtacacaccgcccgtcaagccatgaaagccgggagtacctgaagtgcgtaaccgcaaggagcgccctagggtaaaaccggtaattggggctaagtcgtaacaaggtagccgtaccggaaggtgcggctggaacacctcctttctggagcgtgaccgagtgaaggtcctttcggtcttgtgctgcatgcgagtttgtttaacgaaataaagagagaaagatgaagccgagtcaggaaacagacgaggttgaactgaatcacgcaagctagtcctatagctcagttggttagagcgctacactgataatgtagaggtcggcagttcaactctgcctgggactacctcgaggaaagggagcgaagaaaaaacttccttaaaaatttgctcaagcgaaagtaaatgcttacctttgcagccgcaaaaaaacgggggattagctcagctggctagagcacctgctttgcacgcagggggtcaacggttcgaatccgttattctccactatagaaaaataggtctatgacatgatgtaacaagcaaaaagtaattttagtacgaaagctaaaagtatatatcatcccgcactgttgaaaaatggtgtgaacgataaggaaagtaaagaagggcgcatggcggatgccttggctctcggaggcgatgaaggacgtgataagctgcgataagtcacggggaggtgcaaataacccctgatccgtgaatctccgaatgggacaacccaataccttgaagaggtattaccttacacagtaaggggctaacgcagggaactgaaacatcttagtacctgcaggaaaagaaaataacaatgattcccccagtagtggcgagcgaacggggaagagcctaaaccaccggtgttacggcacaggtggggttgtaggaccgcgtcgttgcaagaaatcttgcgagaagaacgatctggaaagttcggccgaagacggtgacagcccggtattcgaagcaagacgaagcatagcggtatcctgagtagcgcggaacacgaggaattctgcgtgaatctgccgggaccatccggcaaggctaaatactcccgagagaccgatagtggaccagtaccgtgagggaaaggtgaaaagcacttcgaacagaagagtgaaatagtacctgaaaccgtgcgcctacaagcggtcggagctcctaacggagtgacggcgtgccttttgcataatgaacctacgagttgccgtcgttggcaaggttaagggacacgagtcccgcagccgaagcgaaagcgagtctgaacagggcgtcgagtcagcggcggcagacgcgaaaccaagtgatctacccttggccaggatgaagtctgggtaacaccagatggaggtccgcaccaataagcgttgaaaagcttctggatgagctgagggtaggggtgaaaggctaatcaaacttggagatagctcgtactccccgaaatgcatttaggtgcagcctcgtggattactgatgtgaggtagagcgactgattggatgcgagggcttcaccgcctatcaagtcctgacaaactccgaatgcgcatcagttttaccccgggagtgagggcatgggtgctaaggtccgtgcccgagaggagaagaatccggaccaccggctaaggtcccgaaatgacagctaagttaaactaacgaagtctgattgctaagacagctaggatgttggcttggaagcagccattcatttaaagagtgcgtaacagctcactagtcgaggaatcgggcatggataataatcgggtataagttgtctaccgaagccgtggaaccagcaatggttggtaggggagcattccattcggcgtcgaaggcgtaccgcgaggtactctggagcgtatggaaaagcaaatgtaggtataagtaacgataaagggggtgagaaaccccctcgccgaaagactaaggtttcctgatcaacgctaatcggatcagggtcagtcgggtcctaaggctcagccgaacggcgaggccgatggcagaaacggttaatattccgttactaccttggagggtgacgtggagaagcagaagtgacactgccgcgggctgacggaatagcccgttaaagagtgtaggtgctgattcccgcaggcaaatccgcgggaagagccgaacttgacagtatggagcgtcctccgggacaatccaacagcgcaggtaagcagactgccgagaaaatccgctaaacataacttccatggtacccgtaccgcaaacggacacacgtagtcgggttgaatatactaaggcgcttgagtgaatcacggttaaggaactaggcaaactgaccctgtaacttcgggataaagggtccctcctcgcaagagagggcgcagagaataggtccaggcaactgtttaacaaaaacacagggctgtgcgaatatgaaagtagaagtatacagcctgacacctgcccggtgctggaaggttaagaggagatgtcatcgcaagagaagcattgaattgaagccccagtaaacggcggccgtaactataacggtcctaaggtagcgaaattccttgtcgggtaagttccgacctgcacgaatggtgtaatgatccggacgctgtctcaaccgtgagctcagtgaaattgtagtatcggtgaagatgccgattacccgcgatgggacgaaaagaccccgtgaacctttactatagcttagcattgaatttgggcacgcgatgtgtaggataggtcggaggcaatgaagcaggcacgccagtgtttgtggagccgctgttgaaatacgaccctttgtttgtttgaattctaactcccggatggaggacattgcttggtgggtagtttgactggggtggtcgcctccaaaagcgtaacggaggcttctaaaggtgccctcaggacgatcggtaaccgtccgcagagtgtaatggcaaaagggcgcttgactgggagacagacaggtcgagcaggtaggaaactagagcatagtgatccggtgtttccgtatggaagggacatcgctcaaaggataaaaggtactccggggataacaggctgatccctcccaagagctcatatcgacggagtggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgtatgaaatttgcgtggctctgacactagtacgagaggaccgtgttggaccgacctctggtttaccggttgtgccgccaggtgcatcgccgggtatctaagtcgggatcggataagtgctgaaagcatctaagtacgaagccggccacaagattagatttctcagggtcgtcaaagacgatgacgttgataggatgcaggtgtaaaggtggagacaccaaagccgagcattactaattgcccgttcactttccttgaaataaggatggatgatatatactttcagctttgaaacaagtgctggaattgcttgcttgtgagtcatgaatacataaaacgatattcaggtgactatggcacgaaggttccacctcttcccattccgaacagagaagttaagcttcgtcacgccgatggtactgcgcaagtgggagagtaggtagtcgccgtcttgaagaggtcctgcagcaacgacgctgcgggacctttttttatgcccggacgcgacggggaactccgacgctggagtgcgggtactcttttcttttttctttgtaccggataagtcggcttcaggcatgcgcccgccaggctgagttttcttttgcgtgagaattcctgtaaccagggtacagcctgggggattcttgctcgggcatagattctagtcagccgggactggaagaaacagggttttgtccgtgcccgattgaacaatctgatagaatttgtttcttggaatcttttttgtgcctgcttgtggcggaacgtaccggtggctggagtgcggacaagtcggctttaggcgtgcgctcgctagcatgacttttcatttgggtgagaattcctgtaaccagggtacagcctgggggattcttggtcgggcataaattctagccagtctggacaggaagaaacagggttttgtccgtgcccgattgaacaatttgggaggatgcatgtttctggtagggagataaaagattattgaatatttttttctacttttgaacaacatataattcttattgattatggatacaatcattccttatgcactcttgtgttttacttcgttctttacactgacgaatccgttgggaacgatgcctgtatttctgacgatgacaaacggcctagatgagaaggagcgtcgtcacatcgtaaaaagagcgacaattatttctttcattattctgattgcatttaccttctgtggacaattcctgtttaaattctttggaatatctacgaatggtttccgtattgcggcgggtatcattatcctgaaaatcggttatgatatgcttcaggcacgttataccaatacgaaactgaaagatgaagaaataaagacttatgcggatgatatatccattacaccgttgtctattccgatgttgtgtggtcctggtgctattgccaatggtattattttgatggatgatgcgactacatgggagctgaagaccacactggtcgcagtgattgctgtggtatacgttctaacctatattattttgcgcttatcgactcgtttggttgatgtaataggggaaactggtaataatgtgatgatgcgtctgatgggccttattttgatggttatcgcggtggaatgttttgtaggtggtatgaaacctattcttatcgatatcattcagtccagtcattaaacgtagagtcgtttgttctgatataaatattaatcagaaagctgttcaaaattcatttttagataggttactaaaatctgaagtttgaatattattcttaaaggtaaaaaaggaagagtcgtatcattactcaaaaatggagtttgatacgactcttctttttttatggacagtcactgtttgcgacttttcgaagtagcgttttctgtacgggaactatgatgtttatgtctttttaggacctagtacatttatttcttccagaattggagagttccagccttaaccagatcgttgtggtttatacgatagccacacttcttgtcacccatcttgactgtttctatgtactctgagtcactttccggattcatcgtttcgatgaccaactgatcttttccataatatttaggatcgagcttgatagtgatcttgtcgaatgtcggagtagtaagcgtatattcaggtactcccggacagtcaggatagaatcccatcatgctgaagatagcccatgttgacatggttccggtgtcgtcatttcccggtattccgttcggctgagttgtgaaatacttggctagtaattcttttaccagtttctgtgtacgccattcttcccctttgaagtaactgaacaagtaaggataagcgatatcaggttcattggccggatcataataacctttgtcgaataccatttgtaatttgtcgacaaatgctttctttccacccatcagtttggcaagtcctgcaatatcgtgaggtacatagaaggtataattccatgcatttccttcgtggaatcccggacttggttcgaagttttcaccttgtttcggatcgaacggagaatagaatttaccgtcgggcagaatcggacgaagcgtaccaaattccttgcagtaatagttcttgtatcccatagaacgtttatagaacaacttggcatcctctttcttgcctaaggctttggcaagcgtataaagtgagtagtcagcgatataatattccagtgcatgtgataccgaattatcgtattgctctctcaaggggacgtagcccaggttcatgtaatcatcgttgtccggacgcattaaattgtccttacccggcaaggttgccgatttgtacatcgcttcataagccaggttgatatcgaaatcgcgcaatcctttcatccatgtatctacaatgacaggaagactcggatcaccttccattgtcaatgtttcgcgtccatagagttcccatttcggcaaccatccgtgttcgcgatacatatccagcattgtattgaccatatccatctgtcgttcgggatataccagtgtcatcaactgatgcaggttacggtaagtatcccataaagaaaataccgtataacgattcccttttgttgtcagaatcttgtcaccttccatctgcggatattctccgtttacgtcctgcaaggtattgggatgaatcaacgcatgatagagccccgtatagaataccgttttctggtccttacttccaccttctaccatgattcttcccagatcatcgttccagcgctggcgagcctcctgctggatagcagcaaagtgtcttccagactgttccttgtcgagattttctctggcattctttatgctgacaaacgatactcccatggcaacttcaatctgttccccttcttctgtatcgaaagagaaccaggcaccgatgtcatcacctgcgatatctttgttatattgtgtatacaatttgtattttccctgatccttgtcccattcagcctctacgccagacatcggacgctgttttttccagtagccggtagctttaggtgttttattgacacgcattacaaaatatatcgggaagacagcctgcgggttatagcagaatgttcccagcagtttcataccttccacttcacaatcgcttacgcggcgcataaacgctcctgtttcgttggtcaatccttctcctaaattcaggaggatattgctttctcccttgggaaatgtaaagcgtgataaccccgtgcgtggtgtggcagtcgcttcggccaagatattatatttagtcagtgagatggtataatatcccggagtagcattttctttctcatatttacttccgtagttgtgatagtcgacatccagttttccggtagtaggcatcagcagtagagaacctagttccggacatcctactccactaaggttcacatgtgcgaaacccgtaaaaaaactgttggtataatcataaggagtagaccaccagcgtgcgtctttgtcgtatttgttgtcttccgatcccattacattgaatggaacgaccgacatcatgccgttaggacagatagcgcccgggttacaggttccgaagtttgtcgttccgataaatggattcacatagtcggccggttcctgtgcatgcaatgttcctaaggcaaaaaagctagccatgcagattaacagttgtttcataagaatgatattagataaataaaaacagaaaaaggctgtacccataactccagcaagttattcgatacagcccaaaaggttactttatgtaggaatacctatgaaaaaatttcaagggcatcagataatcgaagtacgttttacataatcgataatctcagaaacatatccgaaagccatacctactactgtatcagcagcaccgtaatatacggcaacgcgttctccgtcctgcaaagcagcgcacgggaatactacattgggcacatctccctgcaattcatacggtgcggcagggcccaggatataatcacgggtgcggtacaatactttttccggattatccttgtcgaggatagcggcacccattgaataacggaatccgttgcaagtagtaattactccgtgatagaacatcaaccatccagcttcggtcaggaaaggaacagaacccgctccgatttttgtacactgccatgcactttcggggaacggagttactttcattacacaacgatgttcaccccagtatttcatatcagggctgtagctgatataaatatcaccgaaaggagtatgaccgttgtcgctcggacggctcagcattgcatatttgccgttgattttctgcgggaacaaaacgccgttacgattgaaaggcaagaatgcattttcgcactgataaaattccttgaaatcgaatgtatagccgataccgattgttggtccgtgataaccattacaccaggtaatccagtaacggtcttcaatccaggtcacacgagggtcatatttatattccgattcaatcatttccgtatttccagctttaaactgaatcggttcatgattgatttcccagttgataccatctttgctgaagcccgcaaaaatattcatctgcactgccttgttgtcgcagcggaaaactcctgcgaatccgtctttgaacggaacgacagcactattgaagatactgtttgatgagggaatctgataacgtccgattacggggttttttgagtaacgccacatcacatctgtacatcctgccgggcgatcttcccacggcatgttaaatttctctgccatattctttatattatttggttgttaatttattctctttctccttccatcagggtaccatcctgtttgtatttgaatggtacaaaataagtaatcaggaatgccggtatggttgcaatcagcacaaagataaagaacggttcatatcctcccggcttattgaaccattcgcccaatgtttcgcatacccagccgctgagcatacccggaatcattactcccaagttcatgatacctgaagcaaaagcataatgcgccatctggtgctttcctggagctacctgctgcatcataaacaatgtcaggcccacgaagccaaaaccgtagccgaagtactccagtacgataccactgcaaataagcagtccgttttctggctggaacgttgcgaacaacgcatatactacaaagggtaagttgaatatgcagcacaacgaaaacaacgtttttctcagcccccgtgccgatatataatatccggccagcaaggaacctaaaacgaatgctgctgcgccatatgttccgtaataaagtccgatttccttttcactcaatccgagtccaccgctttctcttgtcgctttcaggaacagagggacaattttcatgacaaatccttctgcaaaccggtaaagaatgatgaaaaagatgtaatatacgatatgacttttcttgaaaaaggcaatcagtacgttcgacaattctttcattatctgtccggctgtacgctgttctccctgtttcttggctccgcctgaaggcaacataaacaagtgatagatacccaatacaaccatgatgacacacaagatggtcatgataatcatccacgccttctggttggctgcgaatagcgcatctccttcggcacctgctcctccatatttttcaatcaggtatccagccagatataccagaccacccgtagcaataatcttggcaatattataaaaagcgccctgccatccgatatatttcgcctgatcatcgttcgacaattcgctcatgtatacgccatcgcatgcgatgtcgtgggtagcaccactaaaggcgatgacagccaacaaggcaatggcaatgctgaagaaatgaggtaaattcaatgaaaatgctaccaacccaaatgtgattcctgttatgagctgagtagcaaccacaaaaaactttttggtcttgaataattcaagaaacggactccataaaggctttattgtccacggaagtaaaatcagtgaagtccagaaagtaatcaatttatcttctactcccagtcctttgaacatcagtaccgtgaccatattcagtaccacgaaaggtaagcccatggcaaaataggcagttggaacccatgtaatcggactttttgcttttttcggatgattgttttgtcccatagtattgtttatcagttaattctttttatctaaataacagtttgtattcagagaatacgcaactttaaattagggttttaatatattttagagtttagcatattcttctgctccaatcttgtctgcatttcctcttgtgggagagttgttgtcatcgttttgctcttgaatattaaaatttatgcaaaacggacagagagtttttaaaagaatattctttaatctatttaattatctgcaaatatacaattttctcttgaatagaagtctgaaatgaacgaagtaagttctgtatatatctaaaaaaaaagtggtaaaataaaagcaggttactttcctttcatatcttcaatgattcctaggaggtaacctgctttcatcgggactcgtcaaacagtccttttatgatttattgttttacttctttactgaatgaatacggcgcatcttcgggtgcgatacctctgttcatgttgggtttgtcgcccatgacataatcgatggtactaccattctgcaaggtagcgtgtgtaatgtaattcttggtatattcctgaccgtttaccttcatgtcctgaatatagtaattggtgtcactgttctgaggagcattgatgacgatgcttttgccattttcaaaatggatggtggctttcttaaacagtggagcgcccaatacatactggtcagttcccggacataccggatagaatcccaaagcagagaatacgtaccatgcggaagtctgtccgttgtcttcatcgccacagtagccgtcgggagtaggagtatacatgcgatccatgacctgacgcagccagtactgtgctttccatggctgtttggcataattatacaggtaaatcatgtgctggataggctggttgccatgcgcataattacccatgttcatgaccgtcatttcacggatttcgtgaatcgggaagccgtagtagctatcgtcgaatacaggcggaacagagaatactgaatccaacatagaaacaaacaccttgtcgccgcccatcagatcaatcagtccctgaggatcgtggaataccgaccatgaataatgccagctgttgccttcagtaaacgcatcaccccatttcagcggagagaacggtgtcatgaacttgccatccttgttcttgccgcgcatcagcagcgtttccttgtcgaacaagttcttgtagttcatggcacgtttggcaaacaggttcacttccttcttcggacgcttcaaatcctttgccagtttatagatacaccagtcgtcgtaagcatattccagtgtacgggccgcgttctcattaatcttaacatcgtaaggtacatagcctagcttgttgtaatattcatatcccagacggccggtagaagacacctccggatgcacgttttcagttccatgaatcaaacctttataaagcgtttccagatcatccacctttacacccttgaaataagcatccaccaaaatggaagccgagttgtttccgatcatacaaccacggtgtcccgggcttgcccattcggggaagaagccgctttccttatatgtattgatcagtccttcctggatttccttgttgaccgacggatagatcaggttcagcaacgggaacagacagcggaacgtatcccagaaacctgtatcggtatacatatatcccggaaccactttaccgttgtaagggctgtaatgaacaatctgtccctgtgcgtctatttcgtagaacttacgcgggaaaagcaatgagcggtacagacaagaatagaaggtacggtactgatccagatttccgccttccacttctaccttacccaatacattgttccatgcttccttacctttttccaccagcgtattgaagtcgtcgttgcccagttccttcaggttcaataatgcctgttccggactgataaacgaagaagccacacgagcatgtacgatttcccctttctttgtagcaaagccgatgatagctcctgcatgatccgcctgctgttccgtgccgttctcttttacgatactgtcggcaacggtagcctgatacgtgaacggtttgtcgaattcgattacgaaataattcttgaagttagccggaacaccaccgctgttcttggtagagtaaccgatgatacggttgtttgccgcatcaatcttgacatacgaacccttgtcgaaagcatccaccactacgtaggaatgttcattttccgggaaagtaaagcggaacatggcagcccgttctgtcggagtcagctcggtcacgatatcgtattctgccagatacaccttataataataggcttttgccgtttcacccttgtgcgcaaaccagcttgcacgcttgtcttcgttgaattctggcttattcaccatcggcatgatagagaactggccatagtcgtttatccacggactgggctggtgcgtctgcttgaatccgcggattttcgttgccgtatactgatacatccagccgtcgcccatctttccagtctgcgggctccagaagttcataccccacggacgtgcgatagccggatacgtattgcctgcagataattcgtaagtcgactgagtacccatcagtgggttcacataatcagcataattagtcgctttggcaaggcagaaaaagcctgccagtaaaataagtaatgataattttttcatggcttatttatgattttattgttttactccccattttgtaggttggttggttaaggttatttccagtgttcctccggcagctatatccttatgctcgataaacggaacattcagttccttaccgttcagcgtagccgactggatatacttgttgtctttggaattattctttgtcaggatagtaaacgtcttgttatcccccggcaagttgattgtcaccttgtcgaagaacgggcgtccgatagaataaaccggcttacccggacaaacttgataaaatcccatcgcgttcaggatataccacgccgacatctgtccacagtcttcattgcccgacagtccgtcgggggcatcacgatactgctccttcagtacgcggtcaatcagttcctgcgttttccacggttggtttacataattatacatgtgtataatgtgatggcttggttcatttccatgcgcatactgtccgatcagtccactgatatcagccgaaacattttctccttccaggctggaatccgtagtaaagagcgagtcaagtttaccgatgaagccctgttctcctcccatcagtttcaccagtccctcaatatcgtgtggagtgaaccatgtccactgccaggcattcccttcgcaataatcatcgtaacgatggttggaagcctttggattgaacgggctgcgccattctccttttgagtcgactccgcgcataaagcgtgtagatggatcgaaatatcgttcataagctttggcaaactgtgcgtattttttctgattcagggagtctcctgtcgcttcggcaaggacagaaatgcaataatcatcgtaagcatattccagagccttggcaactgattcgttctcgcggtcgcacggaatataccctaacgtattcttataatacttggccatcggcatcaggtgcggcaataccagcgccggacatttaatgcccgtcgtatcgtattccgcagcacgcaagcacgccttgtaagcctcctgcaagtcgaaatcagcatatcctttggtataagcgtcggcgataagcgaagccgcatgatacccgatcattgttcccgtatagttcgaagccagatcccacatcgggaagatacctccctcctgatgctttttcagcagcgagcggataaagtcattgttcagctgcggttcgataatagacaagagcgggtgcaatgcgcggaacgtatcccatagagagaataccgtgtagaccggacggtctgcatttccctgatgtaccttccggtccattccccagtaacgtccgtccacgtcggtaaacagattcggactgatagccgtatgatacatagccgtatagaaaatggtgcggtcggtatcgctggaagttgaaacatctattttagaaagatagtcattccatgcctgacgagcgtcggaacgcaccttctcgaaatcccatgccggaatttcggcatccagatttttctttgcaccttccgtatcgacagccgagatacccatctttaccatgacctgctcatcttttttcgtcttgaaactgagcaaaaccttgcagcggggctgcatcttgccgttctggtcggtcagcgtatcccttacaatctgatatgtaaaaggtttggagaacttggcataaaaactgatctgctggtcgaatgcccagtattcagtcagcttatatcctttgatttccgtatcactgaccacgtccaccttcatatccatgtttgtctgatgctggatagagtaatccatgtcgagaataaatccagcctcgtcgcttgccgggaacgtataccgatgcaaagccgcccgcttggtagcagtcagttccgccttcaccttataccggtccagaaagaccgagtaatatcccggttcggcagtttcgttctgatgtgagaattccgacgcatacggcagtgtctggctggcatagtcctgaggattgtatgtctgcttgcctactgtcggcatcagtaagatatccccgtaatcggcacatccggtgccacttacgtgtgtatgcgagaatccgttaatggtagaatctgcataataatatcccgaggaagcatcccagccgtcgatacgggtatccgggctcggctgaatcattccattaggtactacggctccggggaacgtatgtccgtgtcctcccgttccgataaatggattcacatatgcggcatagtctttttccacgcttttcgaggtacatgacactactgccattgttattcctacggcacatgctatcgcacagattttgattttcatggtgtgaaattataagttagataattaggatcttttctttattctctttcagggtaataaatacatagagactttattaaaaataaataacgtgagttcgaaataaattaaaacatcgtgagttgtccgtctttgacaaaacaaacgtcaatggcgggcttcttttcaaagaagcagtatgcagctatggcagagagcgagttggcaataaagttattgaaggaacggtgtctggagtgttcaatctgggcgatgttctttaactcgtcattgactgtttcaatcaaagcacgttttctcagcaggattttgtccgccacgttcatcagggagttcttcatgttgttcttcactttggttatcaactgtatgccgttaaggaacaggttctcgaacagggtttgcccgacataccccttgtccgcacagagtttcccttttatattcttcaggaactttgtctgtttcagcggttcacggtcatccacatttcccggagtgaacatgaaattgaggatttcacccttatcgttgatgatcaggtgaagcttaaacccgaagaaccatcccatggagcattttccacgttcggcgagacccttaaaagtcttgtgaatcaatatgcgttggttccggcatacacgcagcggggtggaatccacaaagctgataccggtgcaggtacccaacaggacttccttgatgaaaatggtcagctgcaacaggacttccttttccagttccacaaaacggttataggacacacgtctgggaaagagatgcgtcagatgtttgcatacatattctttgtagtaatgcttgaaacatctgaagcctcccgagtggaacaggatcaagatgaccatgatttccgcatcactcatccggttcggcttgttccgatgcttatgattcttttcttcaaccatatatttttcctgtgttttggcaaattccttgcaaaaatcatccgccatacaaaaaatctccgtaactttagactctgagaacatagtggtaatcgcttaaatgttatacttagacactataaatttaatgcttttatcgctatgttcctaattttcaaactgataattttaatctttatatcgaactcacgttaaataaatgatggaaaatcaattatttaaaccatatatatcccggtttattccccatttccagttcaagtgtatcgccttccatgatttgctgatgagttatataactcttatcgtatggctgtccgttgagcttcaccgactggatataacagttctcacggctggcattccgggcaatgaccgtgaatgtctttccgttgttcaggtgtaactgcactttcggaaatttcgggctacctatttcgtacctgcctgataccggattgaccggatagaatcccatggcactaaaaacataccatgccgacatctgtccacaatcctcgttgccgcagagtcctgccggagtattggtatacagttcatgagtaatctggctgatgtatttctgtcctttccacggctgtcctgccgcattgtacaagtaagctacatgatggctcggttcgttaccgtgtgcatattgtccgatcattcccgtgctgaaaataggaagttcgtccttgtcggtaggatgaaacgtaaacatgctgtccagtttctgggcaaagcgttctttgctgccggtcagttcaatcagtccgttcacatcatgttgtaccgaccagaaatactgccatccgttgctttcgcagatatgcggagtatattcgtcagccttgaaattctcgatgaagttacccttcatgtcacgtggctgcatgaacgaagtcgccggattatacacattcttataattctgagagcgtgcatagaactgtttggcaatatcttccttacccatcttctttgccatttcggctatgcagtagtcgtcgaaagcatattccagcgttttagaaagcgaccagttctcattattatactggtcgtgcaggtcgtaaggaatatatcctttttccttgtatactcctatgccacgatactcgtcgatgttggctgttgccacacaagcagccagtgctttctctgcatcgaagtcgccgatacctttcaggtaagcatccacaatcaccggtacggcatggtaaccgatcatcatgtccgtttcgcttccatagaaattccataccggcaggcgtccgttctgttcataaaatgccaggaacgacttgatcatatcgttggtacgttcaggctgtgtgtaagtaaacagcggatgtgctgcgcggtatgtatcccataaagagaacgtactgtagttcgtccatccgtcggcatgatgcacctgcttgtcgggcccataataagagccgtccacatcactgtatattgtaggagccagcatactgtgatacaaagccgtgtagaataccgtcttttcatccttgtcaggcgtatctatctgtattttggtaagctccttgttccacatagccttagccttttccaggtacgtgtcgaagttattgtcgggagcttcagcctgcaagttcttggctgccccctccatgcttacccccgaaatggcagttgccagcgtaatctgttcattttcgtctgtagtataatcgaaacgtgcgacaacccctgttccgatacgctttccatctttttcgatggcagtagaatcgattgtcatccgggtaaacggacgtgagaaacgggtgcagaaataaatcttctgtccgcgagcccagccgtcggagaaacgatatccccgcacggttaccgagtcgaccgcttcgatatgagaatcttgcgtcgcatcccagttcatggctttggcaagattaaggaaaatagccgattcagctttcgggaatgtataacgctggataccgcaacgttcggtagccgtcagttccacgttgatattataatcatccagctttacctgataatatccggcataagcactttcgttggtatgtgaaaatttggaatatatacccagcggagcttcggcctccttgtatggaagcgtaaccggcataaacgagacatcgtaaagatcgcctgcacccgtacccgaaaggtgtgtatggctgaagccggcaattgtgctgtccggataaaaataaccggcaatgcgatcccatccgggcaatccgttgtcagggcttagctgtaccattccaaaaggaacttgagctcccggataagtgtttcctgtaaagtctgttccaataaatggattgacgtattgtgtgtaatcttccgtaatacttgaagattgattcgatgatgtacatgcggcaaaagccagagctgtgtaaagtggaattgtcttaaatctcataatactagttttgatttgtaaatataataataaatatgggaaaaacacttattccggtgtctcatttctgccaatttgctatatatgactgtatatagcttctgaatttcaaggtgaaaggatattttgaaaaaatatataaagttttattcccatatactgttatcttggatgtttgtgacaataacctgatcgttcggtaggtatcctgcaaggagagaagttcaggttatgtttggaaatcaagcgagtgatagacggaccaatcgataagttgtcagaaagtttttaagattcatagcggagctgatatgaaaaatagtgatttatcgtgacatctgatgtaaaagaccgggtcttttgaaaaattttccacgaggaccgttgatgtttttgtacaaaaacaataattttttgtacaaagcttttgagaatttgtacaaaaattgtgaggttcacgcagtcgtttgggagcatatgcgttgaaaaatcttgtgccatgaattgaaagatgatttctgttcagagctatttccaatgaccctgaacagaatcgagaaaattatagtcagcgctgcatctgcagtaaattaaatcaatctgaaaattcaaatgataaaagcgttatactcttcactgaacgaatgcgagccgttttcgtttgtgaaatcggttccgagaaaatgatcggataacgtacagagagcgtgtttgcagtcactctgtcggatggctatcgatacgcaatgattgtcattcccgtacgaaatcatcaggataggtatgtcgtgcagcaattcgatgatacgattgcctgcatccgaatctccccagttcagctttccgagtatgctgatagtggcaatattgttttctgtagttatttcggcaaatccggccagttcacggcggagcaggctcagggtttcggtatctgtttctattgccatcgaaatattggtgctggatgatgtcatcagataaatgaataccttgtacttcgcaaagacagaaagtgttttctccagaaagcggaaggaagaaacacttcccgacgagtgcagtcggatgtaggtgatgtgctttcgggctgtgatggcttttacggtatgcgtttcttcttgtatctcactgacgaggcggatgatgcgaccttgtccgtttatcagacggatgttaatctgatattgatgggcaagcgagaggctgcggggcgataccagacgaacgccggcattgatgaggctttcggcttcttcgaaggagaacatggtgccgttgttttcttccggctttttgttgtcgtacgggatgtatatttcttttgcctgtgttcgttgtatgagttcttgagcacggaaagcgatagccagatatacggcataagcgcaactgtcgcctttggcgatatattctacttcaccgtaagcattctggcatacaagcgactgggtgacatagactgcggcttgtgctgtttgcgaaaaagcttgtgcctgctggcagattgtttctaaatcaggtttcccgtcagcatccaggtgcatcagtgtggcagcatctgctacagtggcatcgatgtgtcggctttttaaataggcggctatcagtgcggaagaaatgtattctcccgaaatgagtaatctgcgttcgtcggactggctgaacgtactgtttgccagttgccggatatgttggaagttggatgtgatctgtgtttgggcaaactcgaaggcagaaccatgatcgggcaggaatccggacatcgtttccatgcagcgtttttccagatgcaggatggcttgtgaagccttttcctcttcggcacggaacagatggatggaaatatcttgcaggctgcgtttgatccagtcgaaagcaggaacgataacgaggagaggagcttctttgcagatgacatcggagagttgcaggatgtcttcgggagctgttactgtatctaaattgcagactttcatttcttttcttttgcgttaagtgtttggttatctatgccttttgtttaccttttctaactttgtttgtacggttgttttgtaacgaggcgtaaagatacatatttttatgaaatcatattcctttactcaacttttgtgtgaaggagaattaaaataaaggaaaatgatttgaagaaggcttaaaaatgccttgtcgtaatgagtttatccgattttttaagtcggctttcggttttttctctatatttgcaaccgtctgaatgaaactatatgcacgaaattacattacatagccagagaaaatcgatccgtttccgtcgctggagccggaaaaattatgctgtgttcggaagtctgcaccggcatgtcacgattggacgggtgtgtaagggaattgccgattcatcgttggataaggcaagacatatcgtgtcggtagaaggtaacgggcagcgtgtatatgctatggacggcgtcagggagcaggatgccttggcgcaggatatagggattccgctgggatatgtcatgctgcgtctgatgggacagcctgtggttgttgaaccggcaggtagtgaggctgcttgtagtagaaagattcagaataattgtcatttatcgaaacggaatggcgaaaggattcgtgtggcatctggtgataggtgcatacggatactttcgccattccgcttttttatgtatacaaaaaatagattatgatcgaaaaattagaaaagaaagttgacgacggtcttgcgttgacgcaggaagaggcgctttggttggcggagaaagctcctttggatgaattatatgaagcggctcatcggattacgatgaaatatgcttcgcataagtttgatatgtgttccattatcaatgctaagtcgggacgttgttccgaggactgcaagtggtgtgctcagtcggcacattatgcaacgggtgttgaggtgtacggactggtttcgcaagaggagtgtctgcgtcatgcaaaggcgaacgaagaacagggcgtttctcgcttctcgctggtgacgagtggacggaaaccttccaataaggagatagaggttttgtgtcagcattttgcatacttgaaagagcactcggacatactgctttgcgcttcgctgggactggctaccgaagaacagcttgctttgctgcatgaagcaggggtagtccgttatcattgtaatctggaaacggctccttctcattttgcgagtctttgctctactcacacccaaaaagagaagttggctaccatacaggctgcccgtcgtgtaggaatggatgtgtgttgcggaggtattatcggaatgggggaaaccatgcagcagcgtgtggagtttgcctttaccctgaaatcgctggatattcagtctatcccgctcaacttgttgcagccgatcaagggtactccacttgaaacggagcctgcgctctcggaagaagaggtcttgcgtacggtagccatgttccgttttgtcaatccttcggcttatctccgctttgcgggaggacgttcacaactgagtgacgaggcagtgcgcaaggcgatgtatatcggcgtaaactcagctatcgtgggagatttgctgacaacgctgggttcgaaagtagcagaagatagaaaacgaataaaggaggtgggctatgagttatgaacaatgtgttgataacttcgacagggagcatttgtggcatccctatacgtcgactatcaatccgttgcctacgtataaggtaaaacgggcaaaagggtgtatgattacgctggaggacggtacggagctggtagacggtatgtcgtcgtggtggtgtgccgtacatggatataatcatccggtgctgaatcgggccatcgaagaacagttgaaaaacatgtcgcatgtgatgtttggaggactgacacacgagcctgccatcgcattgggaaagttgcttctgaagattgttccgccttccatgcagaagattttttatgccgacagtggttcggtggctgtggaggtcgcactgaagatggcggtgcagtatcagtttgctgcgggaaagcctgaaaagaacaattttgtgacgatccgttccggctatcatggcgatacgtggaatgcgatgtcggtatgcgatccggtgacgggcatgcatagtttgttcggttcggcacttccggtacgttattttgtgcctgcgcctcagtgccgtttcgatgccgaatgggatgagaaggatattcttccactgaaggaaacaatcgaaaagcatcatcagacgcttgccggactgatacttgaaccgatcgttcagggagccggtggtatgcgtttttatcatccgcagtatctgcgtgaggcggctaagttgtgccgcgaatatgggttgctgcttatcttcgacgagattgctacgggtttcggacgtactggaaaactgtttgcctgggaacatgctggagtagaacccgatatcatgtgtatcggtaaggcgctgaccggagggtatatgactttctcggccgtgctgacttccgataaggtagcggactgtatttcttcacatgagccgcatgcttttatgcacgggcctacttttatgggaaatccgcttgcctgtgcggtggcttgcgcttccgtcaatctgctcttgtccagcggatgggaggagaaggtgaaacgcattgagtcgcaactgtgggaggaattgcttccggctgccggattacctcaggtggcagacgtgcgtgtgctgggagctatcggagtcatcgaaatgaagaatccggtggatatggcatggatgcaacgccgttttgtggaagaaggtatctgggtgcgcccgttcggacggctggtatatatcatgcctccatttattatcagcaaggaggaactgacgaagctgacttccggcttgctgaagattgtaagagaaataacctgttaaataaaaaagaaaggaatgggaacgatggtttcatcggataatttatatagccggacgctcgatgcgctggaggaagcaggtaatctgcggacgctgtcgcaggcagaacatcagggaaaatggatctggaaggatggcaagcgcatgctgaatctttcttcgaatgactatctgggactggctgccgacactgcgctgcgtgacgagtttatgcggacgctttcggaacgtgattttctgttctcgtcgtcgtcgtcgcgcctgctgactggtaactttaccgtatacgatgagttggaacagatgcttgccgagatgttcggtgcaggtggtgcgttggtcttttcgagtggttatcacatgaatacgggaatacttcctgccgtggctgatgcgcatacgctgattctggcagataagctggtacatgccagtctgattgacggaatccggctgtcggctgcacggtgcatccgttatcgtcatcaggattacgggcaactggaggctttgcttgccaagagttataaggattacgaacggattgttatcgtaacggagagtgtctttagtatggatggagatgtggctcctctcgaccggctggtggacttgaaaaagtgttatcccggtgtgatgctgtatgtggatgaggctcacggtatcggtgtacgtggcaaaaacggactgggtgtagccgaggaacaggaatgtctgaaggatatcgacttcctgtgtggtacgtttggcaaggcattggcttcggtcggagcgtatgtagtgtgcagtgaggtgatgcgctcgtttctggttaaccggatgcggacgtttatctttacgacagcacttcctccgctgaatgtggcatggacaaagtttatcctgtcgcgtctggagggctggaacgaccgtcgggaatggttggcaaaggcggctcttcgggtgcaggaagctgtccgggcttcaggatgtgagtgtccttcctcaagtcatattgttcccttcattgtgggcgagagcagcaagactatcctgaaagcggaagacatgcagcggaaaggattttatgtgttgccggttcgtccgcctacggttcccgaaggaacttcccgattgcgtatttcgctgacggcagctattacggaagaggaagtggacagcttatgccgtgaattgtaaagattatgaacgtttaaaaaatatcggcgcaaatgtatggaaacgtcggcgtgttttactgaaaacgtcggcacgttttgatacacgtgcgccgaatgactgaatatgaagcaagtatttataaaaaaagagggtaatccgcgcttgctactcttctttgcagggtggggaagtgacgagcatttatttcgccgtccggtagcagaagggtatgactatctgctttgttttgattaccgtacgctggatttcgattattctttgctgaatggctatcgtgaaatcaggttgcttgcctggtcgatgggggtatgggtagccgggcagatactttcgagacgtacctgtccttgggagatgaagctggctgtcaacggtacgcctttcccgatagatgaccagcgggggattgcggaagcggtttttcacggtacgctggagaatttttcggatgctacgctggcacgtttccgacggagaatctgtggcggtgcaggacaggtgaaggagttcctttcgcatcagccgtaccgtacgacggaggagctgaaggaggaactggcggctttggaacatgaggttggaaaggctctgccggcggcttttggttgggacaaggctatcattggcttgtgtgacaagatttttattccagacaatcagcgtgtcgcttggaaaggaacggaagtgatggagatggaagcggaacattatgatacggcgctgttcggccgtctgctggaaggaaagggggaggaatggacaagacattgattcgccgtcgttttgccaaggctgtgagcagctattccatacgggcggatgtacagcgacagattgcttaccacatggctgatgccataggcaagtatatcccttcggggggacggcgtaatgtgctggagattggctgcggaacgggtctgtttacccgtgcctttctgcattgtgctactcccgaacggttgctactgaacgatttgtgtcccgaagtggaaccgtatctcaccgacttacttgccaataagaggattcactttgctgcatccgatgcggagatgttgaattttccctcggggcagaatctgattgtgtcgtgctctgccattcagtggttcgaccagccggaaaagttcttggcaggctgccgcaagctcctgacgactgacggctatctggctttcagtacgtttggtcctcagaatgtaaaggaggtggtatcgcttacttcggatacacttccttatcgttcgctggcggaactaacaaaggttttgtcgactgagtatcagattgtgtatagtcgggaggaaaagctgaaattgtctttcacttcgccgctggaggtactgaagcatctgaaggaaacgggagtgacgggcatacgtcagcaaagttggacgaggggagaactgaacgatttctgccgccgttataaggaaatgtatgcagcgcccgacggaactgttccgctgacttatcatcctatttatatgatttgtaaaaagtcattagtgtccaataaaaatggactagttaaaaaattaatcaaatagtccttcaaaaaggggataatcgagttctttgacatcgttgaaatcagtcttatcgaacagttcacgcaagttagttttgtccgttagagagatgcttagaatctgcaaaacttcataagttgagcgcttcaattgcatatcgtgttggacaatagccactagacagtaagtgatgattgctacactgatttgaatgcggacagcattttccgttgtgccccagaatctttttattttaaggtgctgcttgagccatttgaagaatagctcgaccaaccatcttttcttgtagagattagcaacgtccaatgcagaaatatgtgttgcgtttgtcaggaaagtgaactcacggtcaccctcttcatcatagtaacgaatgagtcggaatgactcgggatatttcttctctgagaggtatccggtcagtttcacttcagcatctgtaagtacatacttaggcatcctacgcttccatttaaccattgtgtatttcaagttcgtcttagctctgacaacgaaaaaggaacctgtcaggtgtatcctatatagttccttaaaagagtcataagccctgtcgaatatataataagcatttggttcataatggattgaacacatcgctgtagagtcgtgcttcgatgctgtggttacagtatagaaggcaggaacttgtgcttcaatgtcatataagacatgagctttgacacctcctttctttcttcggaacttcgcccatggaaatgtggctagacataacggaatagttgttgaatcaaaagcatacttattccctggaatatccaagatgttggtcgctcgcttttcacaagcttccttcattatatagaatgcgaagtcttcaaagattctgtagtcacgattctgattagcataagcgagggtggctttggctattggattgcgtcccagaccaagatgatattgcttggcttgatgcgcttcaaaagctacaattaagtcgcgaagactctcacgattgctcagttgtccgaacatcatagcaagtaactgattccagcaggtgaattgtttcacgtagcgattaccattatacttgcgaacaaagttattgaattgtgttctgttcataaaagcggtaagttgagcgaatacgtatttatcttggttcataagcggcattcaatttgaccgctaagctacgaattcaaatccgtttcattctaaaatactgcttaaaagactgtatttcaacaatttcaaaggcccattaaccaacttttattggacagtagtggtaaaaagtaaaatgtaataatatgaaagacaatgttttttttgtgagtggcattgataccaatgtcggaaagagttatgcaactggttatctggctaagacatggaacgaacaaggcgtgcgtacgattacgcagaaatttattcagacggggaatgtcggtatgtcggaggatatcgaactgcatcgcaagattatgggaaccggtctgctgccggaagatgaaagtggactgaccatgcctgaaatatttacttatccttgctcgcctcacttggctgccgaaatagatcatcgtccgattgatttcgacaagatagaaaaggccacccgccagttgagtgaaacctatgacgcggtcttgctggaaggagcaggcggactgatggtcccgcttacccgagacttgctgacaatcgattatgtggcactgaaaaactatccgttgatttttgttacttcggggaaactgggaagcattaatcatactttgttaagtctggaagcgattactcgtcggggtattcgcctgcataccgtggcttataatcttttcccggaagaagacgatgatattatccgtcgggatacagaagcctatatccgtgacttgctggcaaaggaatatccggaaactcatttcgtggttatcccaaaattataactataagcacaaatactttaaatggaaaaatctcctgccttggttcatgctaattacatgactgaggcaggagattttcatttagtaacttacagatacaaataaggctgtttcatctttgatattgaaacagcctctttcatctttttcctgggtggacctggagggaatcgaaccctcgtccaaacaaggaagccatatgctttctacatgcttatctctgccttcggttttcgtgcataagcaagaccagagccacccacttataccttagtccctaaaatttcatttcagcctcggaacccgactgaaactattcccgaatttgctgtgccgcttgaccaaacgcttcggaacaagagcttttgagcgacatctcgtttccatcactgtgacggaaataaagctaatctactattcttcgattaagcagcgagagcataattttcgttgccagataattgttcagtaactgagattatagtgcaaatcactgatgcactgcatgcttacataccacatctctcgctgtcaaatccagtcaagcccaagcatgtgataattattgtgcacaaagataggaaatatttgtgatttcgccaaaatataagggattttacgtattttaaacatagaatatagatatagcagaaacttacaactagtttttatttccatttacacaaaatcttagatagtatcgtattacttctggataaataccatcggtttaccaaagtcatcagtttgtatcccagtaattaaactaaggatatgcttcagccgaagttctttcaacaatatcatttttcaagttctgaatgacggctctatcgaatgaggtacttgaagagagatatattaactattttgtttgagataagatttgtaagtcatactcaagaaactcactcattcattgtttttttatgtttcaataattatatttgctatatatattcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgtatatttttgttgagttttaaaatctatttactagtaataacctttaaatcaatacttatgaaaatgcctttatttctcacagcaatcattttatctttgatttctgtatcttgttctgaagaaaatcaattaacagaacctttacgtgaacaatcatcaatttcattatccccaattaaaggaatttcttacgattccaatattataacgaaagatgatgccatttttgttgcaacaaaattcttgaatagaaaaagaacaagaagtgaaatttatgatgcaatacctctttatgattctactggaaaacaaattggtcatgtagtaaatttttctgattctggattctgtatagtttcttcaactaaagatttacctcctattttggcatattctagcaaagggaactttaatataaataatataaataaaacaggtatttcgatatggagagataatttatcttatagtcaagaagaacttacaaaagaagagaaggattccaacagaagattatggaatatttatgaaagctcttccctaaaatccagagcaatggatgatactgagaaaacagcagctcttaataaaagaatggcagaaattcatgaagaatttggaatgtctatagatgtaagacctcttatagcttttaaaggtagtgattttataaataattcatattatgaaatgtttaaaaataaaggaggttcagaattctatactatagtaggagtgtataagaaaaatctgggacctcaaatcgatccttatataacaactcagtggggacagcaaggagtttttggaaaatatgccgtaaacaaatttgctggttgtactgtaatagcagcagggcagcttatgaactattttcaatatcctaagacttatgactggaatgcaattgcgagcaattgttatattaatgaatctgtggcagtgctgagcaaagatattcaagatagatttaaagttaagtatgaagaaaataaaacctcatcaacaataagtaatgttaaagagggacttaaaagttttggatattctgtttcagaaacagatgaaatttttgcatatagattaattgagaaataccataagccactttacgaacaaggtgtagatgatgacggagatgggcatgcttgggttatagatggatatattacgtttgattatcaatattattatattgtagaatatttaagaggtaattctggaagttacagatatgaaagagataacacaatatattctgcaggtgatgataatatggtagtaagtgtattaacgcattataactggggatgggacggaagagaagatggatattatgttacccctcctaagtataaaaataaacttaaacaattaaatttatcaattccccaataatattgtagagcattaataatcaactaagcataaaaataaataactatgaaaacaaaaacttttatcttaatttccatcttggtatctatcctctttacaggatgtaaaaaaaatgaggacgttattggtaataagattcttacattttatatagaattaactaatgaggatggaactcctattataactagtgataaagaagctgaagagtttccttcattgcaaaccatagctgttaatccaagtgatttaatgaataatttcgatattgtttccaaaccgttaaaaggagaaaataaccgttactatttaaagtgttccaattataattctataaatgatagttatgaatttatcattaaaagtaaaacaggttttaatggagaatatttattcgaaattacatgggattctactacactaaaaaatgtaataataaatggtaaagaatcaaatatcagtgaggttacatttgatgatgtgaaatattattcagtgtctttgattattaaataactatctatttcccttatacgtcaaaggaatgaacgtttctgatatagaaaaagaaatatgtaaaattttctggaataaaatttttaaaaatcaactattcctatcataataaacaatgtaaaacagattgcctagaaatgacagaattagactttatatccggtgcttttgatataatttggatggacagggtcaatgtataagataacggcaaaatcataatataatgaactaatttatttgtatttttgatgcccttaatgaattgattaaacatagaaatatgaagacattgataggtgtatgtatggctgctatagctttaataggaaacagttgcatgggacatgcgaaacacgcggaatcagtttccgaagaaacaacggattcattgtatctgctggtgggaagttatgccccgtcgcaggaggaaggtatccgtgtgtatgtgttcaatcaggaaacgggaaaaggaacgtatcggagtggtatatcgggtatttcgaatccttcgtttctcactccgtcggccgacggtagccgggtatacgcggtaggagaggatgctggggtttcttctatagccaatgcgttggcgttcgatcgagcaaaaggtacgctttcgctgatcaactctcaaccgacccatggaggggcgccttgtaatattacgttgagtccgaaagaggattatgtcttgacggccaattatgcggggggtagtgtaacggtatttcctttaggtaatcgtggagagctgctggcgggtgataccttgacctttacggggagtggaccggataaggaacgacaggctcagccgcatctgcatagtgtgctcttcacaccggacaatcgccttttgctagccaatgatttgggaaccgatcgtattcatgtctttcctgtaaatgataagaaaggtgaaggtttattgaatcgtgcggctgcttacgatgtacaattagctccgggatcgggaccacgtcatacgtgtttcgcacccgacggaaagcatgcgtatctcattaccgaactgtcgggcgatgtgattgcgatttcttacgacgaaatgaagctggatactattcagaccatcaaggcagatacgcttgatgctcatggaagtgcggatattcatatttcgccggatggtgattttgtgtatgcatccaaccgcttgaaaggggatggtattgctatcttctcagttagttcggaggacggtacgctggaaaaggtagggtatcagcctacgggaattcatccgcgtaactttgtcattacgcctaatggtaagtttttactggtagcttgtcgagatacaaatgagattcaggtatttgcacgggatgccgataccggattgctgaaagataccggcgagaaaattgaaatgtcgaagccggtttgtctgaaatttgttccgatgaactgatactgaagaaagacttgtttcctctgtataagagaacggtatgtcaatactcaatggatgagggtaaatcttccattgaatatccaatggaaaaagaaagggtcgtatcaaattctgtgaaaatgatacggccctttttattgtagtattgtctagtcctgaaatagcgttacaacaaaaaaggtaacattatggaaaagacagaaacaaagtacgttaagcgcacacaaaaagattacagtatgtcctttaaactatcagtagtgcaagagtatgaaaccacaaaaataagtttgggagcgctgaaacgaaaatatgggatacaaggatgttcaactattagccgttggattgaaaaatatggtaactttgatatcacaaacaaatgttaccattctatggaaaagagtaaggatcaaaaactgttagaactacaacagaaagtaaggttcctggaacgcaagaatgcccgtctggaaaaggagcttgagctgaaggatatgaaagcagagtttttcgacatgatgatagacatagcggaaaaggaatataatatcgacatacactgctgtccggagaaaattctccaaaatagctattattgattaatactcagttagttacgaggctaataaaatttttcgattagaaatcatagttttgcaagaaggtataaacagccaattctgcaagctatgaacaaaggaaaaacaatatttgcacaggttatgtctcttataaacgtatacgaatttaagaagtgcgtcaaccgctataagggtgacaggcacgccgtcaagttcacttgccgtgaccagttcatggtaatgagctttgcccagttcacagacaggtcaggtctgagagacatagagactacacttaacctttgttctcctgacctttaccgttctggtatcaaggtaatgcccaaatccaccttggccgaagcgaatgaaaagaaggattggcgtatctatcaggattttgcacaagtactgatacggcaagcaaaggaagcatataaggggcagaaacttagacttgacttggatgaaatggtctatgcttttgacagtagcacaatagaactgtgtctgaagctttgtccatgggctaagtttcatcatgagagaggagcaatcaagatgcataccttgatggatcttaggggttccatcccgacatttgttcatctgacagaaggagcagtccacgattccaaaattatggataagatacctgtagaagccaactcttattatcttatggacaaaggatatgttaagtttgactctttgttccggcattttcatcttaattatgccttttttgtaacaagagcaaaagaaaatatgctttacgaaattcttgatagtagagaagtagaccaatctgccggacttctctctgatgaaacgattaaattgaccgggccactcacttccaggaagtatcccgattctcttagacttgttgtgtatgaagacttcagcacaaatacagtttaccgtttccttaccaataacttcaaacttgaggcattgactattgccgagttgtacagggagagatggcaaattgaactgttcttcaaatggataaagcagcatctgcacataaagacattctatggaaccacccaaaatgccgtgtacacacagatatggatagctatctgtgactatcttctgcttatcattgcgaagaaacattatatgttgaatccaagccttcattccatttcaaattctattggccaagtcctcttcaaaagaggcgacatcaaagatatatttaatcaaaccgacatcactactaatgttccagagggtgatggtcctaagcagcttacgctgtggtaaaatttctccggacagcagtgatcgacatacgaaaaaactcctctcccgaacagtcaataaatataaagaagaaaaatccgtaagtatcagcggaatctgccgactgctcgggataagcaggcagaaatattaccgtcagcaatggaagataatccgaggccggcaaagggccactgatgttgtgggcatggtacgagatatccgaatggaactgccacgtgtaggaacccgcaaactttatcatatgcttcatcagccacttaaggagaacaaggtaggcagggacaaactgttcgatatactccgtgccaaccgtctgcttataaagcccgtacgttcatatcatgtaacaaccaactcgcatcaccggtttcggaagcacaagaatcttgtagaaagtatggaagcgacacgcccggaagaaatatgggtttctgatattacttatattggcaatagaaaccggcatatgtatctttctctggttacagatgcttattccaagaagattatgggatatgatctttccgattccttggacactcaaggttctttgaacgcgctgaggatggcaaaccgcaaccgactgtatagggacacgccattgatacaccactctgaccgtggtatacagtactgttccgatgcatatcagaaattactgggacaatatcacatcatacccagcatgactgaatcttacgatccgtacgctaatgccgtggcagaacgaataaacggaatactaaaacaggagttcctgcttgaggaacttaatctaccgctatcagatatgaaacaggtaataagggatgctgtctacaagtataataacatcagacctcattactcttgtgggtataaaacgccggagtatatgcatcatcagaagctgattaaaattaaaagttacaaaaacaaacagttcagcaagactgaccttgctgaactgtgataaataatttatttttgtccaataactgtaacggttatttaggactagtcaactagtcaattacatcttgttctcccgtcacttgagtgttcggggagttttcatatttattatttcttgtccgtcatctgataaaccagtgtaccacctttcacaatgtcggcatgtgaaatgaagttcttggtatacggttcaccgttcagtgtaatactctttacatacttgttggcttctgaaagtccttctgccttgatagtgaaggtctttccgtctgccagatgaagtacaaattccggcatctgaggagctccgaatacgtattcgccgcttaccgggttgacggggtagaatcccatggcagagaacatgtaccatgccgacatttgtccgcagtcatcgttgccgcacaggccgtgaggctgaggtgcatactgtgtgtcaaagatttggcgaatcagttcctgagtacgttcaggacgtccggcaagggcatacagataggttacatgatggctaggttcattaccgtgcgcatattgtccgatcaatccggttacatcggcctgagttgtttccagtttcaatgtaaatacagagtccagcttgttgaggaaggcttcttctccaccgaacaaggctatcaatcccggtacgtcgtgctgtacatgccaggtatattgccatgcgtttccttcggtatagtcgccgcctacactttcagagtgccctatctggctagggttaaatggagtttgccaggtgccgtccgattttctggggcgcatgaacttcgtacttgggtcgaacaggtttttgtagaaatctgcacggcgtgagaagtattcggcatcttctgtttttcccatacgtttggccatgtcggctgctgcatagtcatcgtatacgctttccagtgtagatgaaacagattcagcctcggtcaggtcagtcgggaaataaccgtatttcatatagttttcccagttcgactttaacggatgtgatatggtctgagtacgcttgatggcgttgaatgcgcgttctgcatcaaagccgcggaatcctttggcataggcttctgctacgacagaaactccatggttggctaccatacagaagttttccttgccccacaatccccaaatcgggaggtatccttgtacatcggcctgatctaccagcgagttgatgaaaccgtctacccgttcaggaatcatcagtgtatagaacggatgagcggcgcggtaggtatcccacagagagaaagtagaatagaatttacctcctgttgcgtttactacagagtcggctgcattgcgataacgtccgtcaacgtctgatatttcgttcggctgaatcagcgcatgataaaagctggtgtagaagtttgtcttttcttcgtcagtgcctgttacctctatacggctcaggtaactgttccagtcggctttagccgctgttcgtaccccttcgaaatcccatccgggaacttcagcagccatattggccttggcaccttctactccggtagtggagagcgctactttcatcagcacttcttctcccggctggagattgaagcttgcaacgattcgtttgcctttttcgactgctgccataggaagttcgaagtgatcaacgaccgggcggctgaattgcatgacgaaataatagtcctgattcacccagacttcattgtttacatgaccggtaagcgtactatcgttctcccagttgacttcacagctttttacttgagtatggtattgtttctcgttccataccggtccgtgctgcaaatctatcagaatggaagcagagtctgctttttcgtacgtatatcggtgtagggccgtatgggttgtagcagtcagttctgcttttacattcgattggtcgagggtaacggtataatagccgggagtagcactttcgctttgtttctggaagcgactccggtaggcatcccatgcacggtgacgttgtccggtaaaaggcattaccagaatatcacccagatccatgcatccggttccattgaggtgagtctgagtaaatccccagataatagaatcggcatacatgtattcggagcagtatctccatcctacagctccggttacaggactggtttgtatcattccaaaaggacgacaagctcccggaaaagtatgtccgttgtcggctgctccaatgaaaggatcgacatattgcgtataatctattgtctgtgatgtttcttgcttggctgtattgcaactatagaatgcgcttcccagtgcaagagtgtataagaatacagaaagttttttcatgaattagggttaataagtatggaaaccaaatctattaccatagagtatccagcaacctttgtcgttgataggattttctgcaattggaattttcttgcaacctctatggtaatatactgattgattaatagataatcatttttttataaacgatgtgttatttatacataagtctcgaggaacttcacatgaccttctggaactacttccagagttttggttgtagcagggaacagaacagattctccagcctgcatctgaagtgtatgtccttcgttgtcggttactgtacaagcacctttcatgcagatataaatgacaaacgaatccaattcagtataatccatgctcatctgttcggtcagatcataaacagaagtggtgaagtaaggacaagtcaccagctctaccggttcattctgttttggagtataatgagtgcggtaatcttctgatacggtataatcgattgcgtctttagacaattcagtatgcaattcgcgggtattgccgtttttgtctttacggttgaagtcgtagatacggtaagtaatgttagaggtctgctggatttcagcaatgaaacagccggctccaatgctgtggatacgtcctgccggcaagaagaatacatcacccggctgtacagcatagtcggaaagtgcatcgcagattgtattgtcggcaatcatagcagcatactggtcgggagtaatctgtttgctcaggcctgaacgcaggtgtgcttttcctccatcgttacctatcacataccacatttcagtttttcccatagagttatggcgtttcatggccagttcatcattggggtgaacctgaatagacaagtcttgctgtgcatcgatgaattttatcaacaaagggaatttaccattgaagcgcttgtagttgctttcgcctaccagtgcacctttgtattcgcttaccatttgtgtaaggtttttgcctgcatcggctccatcggcaacgattgactcatcacctggaacgtctgatatttcccagctctcacctacttgtgcctgctggcagtctaagtgcttgaacggaatgattttttctcctccccagatagtggattttaagatcggtttaaattttaaagggtacataagtgttataattaggtttacaattgtaggcaaatgtaacaaaaactcgtgatagttcaatgaatattttgtttattctggagatgctcttatgggttccttggcgttttatctttttctcgtagtgattttgcagctgattagttctgtaaagataaactatcttgagagagcttccgtatttttctgttatatctgtttcatccgaagtctcaggaaccttattggtcattgtaatataaaaggctgttccaatcggaacagccttttgttgaatagttattactatatgttggacagaaaattaaattttgttgccaaaagtaatattgaatcctaaactgacattggtattcagttttcctactggaacatattgtggggttacttttgtcatcaggtgatccatgccaatgaagaagttgaaaccacatggatggaagttcaatatccatccaaaggatgaaccaaatgatgatataccgtaattaacacctgcatcaaaccatttgacgggagttacattggccgaaatacgtccttcgctccagctatatttaccattaatacgtgttgaagacaagaacccgaaatgtaatttatcgtacaaggggaatgtataatctgctcctatattcaatgtagctcctaatgcttttgttgaactgcttcctgtttctgaacggtggaaacttgcataattttcaacgtcttttcctaaatcttccaactgatcttccaatggtttgtcgccagcagcatcatctgatcccattgctatattctggaaacccttgaactcccacggagtattgctcgttttagctttaatcgtattactccaagagataaatcctaaatcgagaacggctgctgacagcgttaaatcttcacgaagcttgtaagtcgctcccaagtcgacagccataccgaaacctgtaaggccgggactgtctaaatcgatattgccccagtctatcaagtctttttctgatggattgttgatttcttttttactttcttctttggtgggcatggttaacccttttacagaggcattcatctctccgttagcctgaaccatccacttatcttccgccatctggactttcatatctgtcattttgagattgacgttacccatacctaacagaaattttaatttaccgccgacatttaatttatcattgatctgacgagaatgtcccagtgctatttctgcatagttgttcgatgaaatacctaaatcatccatctcatatacagagttgctgctattcattcctagtttcatgaattcgaagagtccacgaggtaaattcaggctggttgtagaacgcatgttgatatcaatcgtgttaaagcctccccatgcacggaatccagcagaaagcaatgtcatattcaggtctgtattgatacggttattgtctttcaatttgccgaggaattcactgctgctgatgttgccgttcatgaaagttgtcagcttattatttccatacggatagataaaagtatttaagccaacattcgattgagctcccacattgatattaccgatgaccggaatggctacataattgcgttcaggagcaaaggccgggttcatcaaatgacgatatgtatatccttcgagaaaatagccggaatgtaaggattgtgcagaagcggatgtacccaagcatataaaaattgtagctgtaaaaaggtgaaatatgctattctttttcatataattcaatgattgttattttataggtttaattaattcagatcaacggtaacgccgccttttacttttataaccattttgtccaagcggaggtattgattcttgttcaggatttttccacttgtttcagcagatgaagttgctgcaacttcatagctaagtccgtctagttgcttgaatacattggcatctgttgctttcaatgtaatttcaagtggggttgctactcccttgtctgaaatacctgctgctattttacttgaaactgttgtagagatttcattcaatgtctttccgtccttatctattgcgtttacagtcatatccattgtcagaggaatggtattggttgcttccatcgaaacaactagttcctttacagaaaggtctttaatatctttattccaatcattaataatgtcactgtaaacaatgtttgttccttcattgaattccaaaggagcatttatttcataatctgtcttaacattgtatgtgcttcctaagtcgatggtacatttcttgtcggtagcttttgtctcgatgttgtccatacgaatttcatcaggaattgtttctattaaatcattcaggttttcaactgttacgctggcattagcgccttctacattctcgttcagtctgtgcaggcagataatgtaatcgttatgattaccaggtatggttatcaaatttggagactgtccaacaggaacagatgcaagcagtttaccgcccttatatgattttaatacaccattaaagtttatttcgacaggagaagtgttgctgaccgtcaggtatattttaggatcagtcatatctattttgactttctcgtctttcaagaaatcgggcaaattgtttattgtgataggatcgattgatacattaatttccggatcgacttgtgctgtaacttgagtcagttggatttcgtcaatcttaaatgctgtattcatgatcatctgaatagcacttcctccagtagttgtactagttccgcttatttttatatcgtctgcaatgactaagtgtcctggagcaaccagtccttttccttctcccatcgattcaaaatcaatgtgtgtaatatttaggaaaatttttagtggtgaagtttgggaaacattgatatcctgtatgaatgtcaagacacttcctactatcttaactcgctggtctgttgtggtgatagtcatgtagtcaggaaactcaatttggaatccttttttgagtgtcagtgaattactcccttccacgttcataagtaacgatgcaggcataataacgtctgaactatataatttggttacgtcagtcgttatgtttcttttatcaatgctgaaggaggtcttatcgtttactgttgcttccagtgtaccactcggcaacatcatatagtttaattctgttcttgcagactggagtgcgatctcactcgatttgatggtgatttcttcaatagaaacacgagtgtcggaacctttgcctgtttgagaaagagtataattgccgttagcgtcagctttaactgtactctcttcgtttaagtcgaaaattttctctagtgtgatgtttttggtgttgcttgctggaatggttagattctcgccccctaccgtcactgtcatgtcgagatccttacttaaatcatactcactatctacgcatgatagcatacaactggatagtagtacaaatgcacaagaaaatgttttgtttgtcagtcgtttttttcatgaaataattataattaataagtaacaaataatcgtctttctgataaaaagttcaaataatgtatctgtgcagataattactgatgatgcttatgtgaagaggaataaatccttcactttattaattttaacaataaaaacgtaaaaatgtttataattgttcacttctgatttagaataaatattgtatgtagctataggtaattttatcaatccccaatatattaccaataaaatattgctgtccgataaactttcgagacgataaaagcgttgttcttcccctattgggaaagttttatcggacagtaatataaacagaaacttatgttttaagtatctgttctttgtttttgcttataacggtgctacttctgtaagtacctgatataccgagctgcatactcccagcaggataactcccatcaggcagataaagagacaggcacgggtcatcgtactgctcttgaatgtagccagtggcgtatcgtttggagtaatgtacatggctttgacaatcagcaggtagtaatacaatgagataattgtattgaccaatgccaggaatactaccagccagtggcctgcatgaaatgccgaagcaaatacaaagaacttagagaagaagcccgcaaagggaggaatacctgccagtgagaacaaggcgatagtcatgacgaaactcagtttcggattcgtcttgtagaagccgttatatgcgtcacggtctactacacctccattatgttgttctacggtattgataacaccgaatacagccaagttggcaacgatgtaaactactacataatataccaatgaagccattccctgagccgaggcacccagtacggccagcatgatgtaaccggcttgtgaaatactactgtatgccataaagcgcttcaagtccttttgcaggatagcaaatatgttggctatagtgatggtcaatacgatgattacagaaagcagcaagctccagttgtcaatcatcggggtaaatactttcagcaggatgctcatcaacgcaaaggcagcagctcctttcgaaatgacagaaaggtaagcactgacagttgtcggagctccctggtaagtatcaggtgtccacatgtggaagggaacaaggctcagcttgaatcctaatccggcgaagaacaagaccattgccagtatctgaagcggactacctaccagttgtgtactcaggtcattgaaatacatcgttccgcacgtaccatatactaatgacaaaccgtaaagcatcaatgctgatgagaacatggcattcaaaatgaatttagctccggcttcagcgctgtggtgacgatatttgtcgaatgcgataagacaagccatcgggatgctggccagttcgagtccaacatagaacagcaggaagctgcctgcactgaccatgtagtacatacccaataaggtagagagtgtcaacagataaaattcacctgccttatggcgagtgtcttcacggttcagccaggtatctgcttgcataaataccagcaaggtacccagtgtaaggataatctttacaacagaggtcatcggagtattttgaaacatacctccaaatgcttctccactggtggtagaaccgaatatattgttaagtagcaggatcacaagcaatgcgcaggaaagtctttgcatgttcttcggagacggcgtcttctgaaataaatcggcaagtagcacgatgatcagaacgattgccaaaccgatttctgcctgcatggtgtgtaaagttgttattatatccataatgcgttataattgacaaagttgtgaaataataggttctacactgccgctgattacatgacttacccagtaaggagccagacctaatccagctacagccacgataaggcagatgacggcgaagcgttcatcccaagttgcatcggtcagtttcagatgttccgggttggtgcaggtaccatatagtatcttaccaactacacgcaagatgtagactgcggtaatgacgatactcattgtagcaatgatggtgcatacacggtggaaaacatctgcatgctggaaagatccaacgaatacagtcatttctgcaacgaaaccgcttaagcctggaagaccgaggttagcaagaccggcgataacgtatccgactgcaaggaaaggcatgattttcatcagacctcttaactgacggatatcacgtgtgtgagtacgaccgtaaatcataccgatcaacgcgaagaacaaggcggtcatcaatccgtggctcaacatctgaaggatagcacctatcgcacttacctttgtcatcatcagcaaagcaaacaacaccagtccgcagtggcttactgaagaataggcgttgatgtatttcaagtcggtctgtactacggcactgaaagcaccgtatactactgaaatggttgtcagtaccaggaagaaatctccccaaatagcagcacctgttggcatcaggaacatggcgatacggaagcatccgtagcctcccagtttcatcaatacgccggcatgcaacatagatacggcagtcggcgctgaagcatgaccgtcggggctccatgtatggaaggggaataaagcgcccaatacaccaaatccgaggaataccatcgggaagaaaacgcgctgtatttcggttggtatctgtaatttgacaatctcaaggatgttcatggtttcacctccggcaccgtagaagatacccagaataccaatcaacaggaaggcagatcctcccatcaacatcagcgtcagtttcattgctgcatattcttttctgccgctaccccatacaccgataagcaagtacatcggaatcaaggcaacttcgtagaacatgaacatggtgaacaagtcggtagaaataaagaaaccgaatactccagtactcaatagggtaaaccagaggaaatattctttagtcaacggtttcagcttccatgatgcaaaggttccagtaaagacgatgatggaactcagtaaaagcatgacaaccgaaatgccatctacaccaaccgaataagcaatatgtaatggagcataccaggtaatgctgtctgtgaataacatttcttctgtagctccgccgtttcgtagtcctatataagaaactgtcaggtaggtagcaagaatcaacagaagtgttgagccggctaccattactcctcttacctggttcacgttgcgcgcgatccatagtccgagcaacatgagcagaggaattaaaacaaaaagacttaatatattcataatactaataacatgacggttaatactataactccgcccaggaaccacatggtgtagctctgaactttaccattttgtagaggctgtacgctttcgccggcagcattggtactccatgccatgaagttcatgaactggtcgataacgtgacggtcgaaccatgcaagtggagtagagatacagcggaaaataatcttcttggtgacgaacatccagatttcatccatatagaaacgtctgtatgctgcacgatgcaaggtactgaaacgttttgccagcatgtctgcaacgggctgtttatcgcgtgcgtacatccatgtagcaagtacaatagctatgacagctacgatgacactggttatagctacttgtgcgttgaggtgaatatcgtatgcttcaccgttagccgaaacaaagtgtccgaaaggaagaatccatccgcagacgatggttacggcagcaaggaacatcaacggaaaggtcatagtcagaggactttcgtgaggaacgtgctctgcatgaagttctttgttctctgtaccccagaagattccgtagtataagcggaacatatagaaagctgtcataccagcaatgattgtcatgatccatcccattaccgggctgaactggaagcaggcagtcagaatctcatccttcgagaagaaaccggagaacggaggaataccggcaatggccagacaggcaatcaggaatgtgatgtgagtgataggcatgtatttgcgaagtcctcccatggtagacatttcgttgctatgtactgcgtggataatacatccggctcctaagaacagtaaggctttgaacatggcatgagtgaacaggtggaacattcctgccatataacctaaaccgccttcgtgcgggctgttggaagtacatacaccaagtgcaaccatcatgaaaccaatttgtgagattgttgaaaaggcaagtacacgtttgatatcgctttgtgcacaagctacagatgctgcatagaaagcggtgaatgctcctacataggcaacccagtgcagggtgtggggagcaaatccgataaataacgggaacatgcgggctaccaggtagacacctgcaacaaccattgttgccgcatgaatcagggcgctgaccggagtcggaccttccatggcatcaggcaaccagatgtgcagcgggaacatggcactttttccagcaccacctacgaacatcagtcccagggcccaaggaagtaccattccggctttcatcagttgctcttcacccggagtgaaagtaaaggtgtgcatgtagtagccgtaaatcagaataccgatcaggaatcccaggtcggcaaatcgggtaacgatgaatgctttcttgctggctgcgatagcttccgatttcgtatagtagaagccgatgagcaagtaagaagaaacacctaccagctcccagaacacatacatctggaaaatattcgtagcgaggacaagtcccagcatggagaatgtaaagagcgacaggaatgcgtagtaacgctggaatcctttttctcctttcatataaccgaatgagtagatgtgtaccatcaggctgactgtagagatgactaccagcatcatgaccgaaataggatcgagcaggattcccatgtcaatatgaagggagtcggtgaaaggcagccactggatgttccatggagtcagtgtcgggaatactccttcggcagtacgtggcgctgtaaagtaattgatagcggtgaggtaactcaatacggtaactatggccagtgagagagttccgatcagccccgctacacgatgcttcatgaacatgcctgtcagtcccaggatcaggaagcttagcacaggcagtgcgagtatcagaattgtatattccataatcaaaatactgttttagttatcctttcagatcggtaatatcatcggtcaagatttgtttgatattgcggtacacattaataataatggcaatggcaacagcggtttctgcggctgcgatagcgataccaaacagactgaagaaatgaccttccagatgatccggaaaaaggtaacgattgaatactgcaaagttgatgtttgttgcgttcagcataagctctaccgagatgagcagggcaagcaggtttttacgggtaaagaatccataaattccgcagaacatcataatggtactgatgaccagataatgtattacgtgtatttctatttccataatcgtaattttttatttttcctttcttgctatcagaataccaccgatcatacatgccagcaacaagatgctgactacttcgaacggcagaacaaactggtattttccagtaccgatcagtgccagaccgatttcgcgagccggtaattccactccttgcggaatcatgttaagcgcaaatccgttggtgaagaccaggaacaataccaatgtagctccaatgactgtcgtaagcagtacactgacgagtttggcacggttcatccggtatttcatgtctttgtccgactgggtcagcaggatggagaatacatataatacaacgatacctccagcgtataccattaactgtacagcacccaggaaggtatatcccaatacgccataaatagctccggtgccgaacagcacgaaaagcagataagtggcggcacgtaagatttttccagttgttactgccagtacggaaaatactgcaatagctgctgcaacaacatagaatacgatttcttgaagtgttaattccatattctctcctttttatttagcaagtgttgaaccttcgtggtttagtgtcagcaggagcttatctttttcgaagactgcattttcaaaatcgttggtgaacttgatagctccatgagggcatgcgttgacgcataactcacagaacatgcatgagcccagattgtattggtatttcactaaaacctttttctttttaccatcttcatcttcgcgcatttcagaaataaccttgatggtgccgttagggcaggacatctggcacaagccgcaggctatgcagtgatgatggttctcactgtcgtgtatcataacaagctttgcgcggtgacgttcggggatatgcagcgtagtatgacggttttccggatactgttcggttactttgggctgccagaatactttcatggacgtgcgcataccgatcagcaggctctttactcctgaagcaaatccttttatatattcactaaaactttccataatgttttgttgatagcaattcctatcttatcggttgattaaaatgttaatccaaaaactttacataaggccataaccagcagtacaaccagtgaaagcggcatcaggtatttccattccagtgtaagtacctggtcgatacgcagacgagggaatgtccagcggatccacatcagcaggaaaacaatgaagaaagtttttcctacgaaccagattacacccggaatataatccatgacagcgttgaatccgtccagtccggcgatatgcaatggcatccagcctcccaggaagagggtagtggcgataccggcagtaatgaataagttcaagtattcggccaggtagaagaatccgaagtgcataccggaatattcggtatgataacctgcggtaagttcttgttcagcttctgcaaggtcgaacggaccacggttggcttctgcgttaccggcaatcagataaataatgaatgctgcgatagccggaatgtgtcccttgaagatattccatccgtcagcttgtccgcttacgatttgctggatatccatggtaccgctcagcatgaccattgtcagtactgtcagtccgatagaaagttcataactgataatcatggcaccgcttcgtacggctccgatgatggtatatttgctgttactactccatccggcaagcaggatacccaaaacaccgatagatgaggcagcaagtgcaaagaagataccgatgttcatgtgaagaatttctcctcccttattccatggcaggcatgagaaggtaaggatggaagccagtataaccaagaatggagcaaggttataaaggaagtgatcggagttcttcagttcgatgatttcctttgtcaggattttgataacgtcggctggtacctgtagcaagcctcctttacctcctacacggttcggaccgatacggcactggaaagctgcgcagactttacgctccatataaattaatatgatggcaagtacggcatacagcaacaagattactacgcctactaccagtccttccagaaagatagccagcccttccggcattacactgcacagggcagagtggattgtcaggaaaagcggttcaagattataataatctaaaaacatatactttaaattagaaatgataaattaagaaagctgttatctgtctatatccggaattacatagtccattgaacctccgattgcaatcaggtcggcaatcttgttgcctttgcagactgtatcgagggcatgtaccaatggaagtccggtagaacggtaatgcagacggtacggcgttttgtcaccatggctttccagcattacgccaaattctccacggctgctttctactgctgccgaataattgccttccagtaatttgatgattggtttggtcttgacacgatattctccttccggaatattatcaatcagctgttcgatgatatgacaggattccatgatctcgtccatacgtaccatgtagcgtgcaaatgaatcaccttccgtataagtgatttccttgaaatcgactttgccgtacatggcgtaaggatgatgcttacgtacatcatttgcccagcctgaagcacgtccggaacctcctgttactcccagtgagatagcgtcttcacggcttagcactccgattcctttcagacgggtagtagcaatcacgtttccggtaaagatatcgtgatagtctttgatgacactacgcaggtgcttgataaattcttttaccttgcgctggaagtctggatgcagatcggcttgtacacccccaatcatgttatagttttgtatcaagcgtccgccggttgtctcttcgaagatgtcgagaatcatttcacgctcgcggaagccgtagaagaacggagtcagacctcccatatccattaccagacaagaatagaacagcaagtgagagtcaatacgctggagttcatccatgatggtacggatgtactgtgcgcgttcggatatctcgatgcctgctgccttttcaatacacatacacaatgcatgacggttctggtgtgcactcagatagtccagacggtcggtcagtgcaagtgtttgcggataagtcagactttcattcatcttctcgataccacggtggatataaccacagataggatcgactttgctgatggtttcaccttcgagtgaggtacgcaaacgaagaacaccgtgagtggacgggtgctgcgggccgatgttgacaacgaagtcctgctgtccgaaaacgatatttttcttatcggcgatagttccgtccggattgaggtaatattcatcggtaatatcggcattttcttcgttctccatattcaatggattggaatccatgtcgtaatctttacgcagcggatagcctttccagtcttcacgcaagaacaggcgtcgcatatccgggttgttcaggaagcggatgccgaagaaatcgaatacctcgcgttccttgatttccgctgttttccacaagtcgcaaaccgaaggcagataagggtgttcgcggtcggttgtcgatgtcttgagtacgatgcggctgtaagtcttgctggattccagataataaagtgctcccagaccgccttcctgccagtccattcctaccacatcccgcaggaagtccatcggctcgtccttgtcatttctcaaggcttcggctacttgatggaatgattctgccggaatcgttaccacctggtcaccttgttcggcgactgtgatacctggcactaatcgggaaattttttctattatattcataaatcgctattttcctgtcgtttactatttttcactatcctcttgtggttcgggccttttctcctgacggttgacgcctccgaggaacttttccactttaatcttacgctggagctgcatcatgccgtagtaaaaggcttccggacgtggagggcatcccgggatatatacatcgaccggaataattttgtcgataccgtttactacgtggtatgatttgatgaacggaccacctgaaatagtacatccacctacggcgatgacatatttaggatcggccatctggtcatacagacgtttcaataccggagccattttataagtgatggttcccaataccatgatcatatcagcttgtcgaggagagttacgggttacttcgaatccgaaacgtgccatatcgtaacgtgctgctcccaatgccataaattcgatggcgcagcagctggtaccgaaggtaagcgaccagagtgaattacttcttccccattcgataagttcatcaattgttccgatgatgactcctgcaccgtcgcggttcagttcgtctaccatgcgttgcaagtagtcgttgttcttgaactcatcgtatttcatcgagcggatttgaggtttctttatttccattccagcgctcctttccgccaagcataagccaggcctaatattaatactaataagaaaaatgccacacacaccagtgcataggttccgacttcgttgactactactgcccacggaaacaagaataccgtttcaatatcgaacatcaggaacaagatggcaaacaggtaatatcctaccttgaattgtacccatgattgtcctcgtgtcggtataccacattcgtaaggttctcctttctgtggattgaacgaccgcggtgcaataagctttgcgattgtcatagcggctaccaccagagctatggccgtcagaatgacgacaattaaaaatgtgaaaaacataaataaaactttatattgacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgattgataaatcgtacatataactttatatggtaaaacgctctttaccatataaatagaaatgaatattgaatctctctatcgttatagagaaactaaatcaatattttttccagtgtatagatataataggagattctgttatagagaggtgggtgattgaagcatgcgaaacgctgttgcttgtctgttccgcgttctgcttggcagatgaggcttacggcatttcgtagtgctgacttaaaatcatacgtattaatcgtatgagtaattattgttttgttaggtatatcggtgttgttttgtgttgacaaatactgaagcgttctctctgcctcctgctgaggctcttgaagttcactgtaagtggaagtgtaagaaaaaagagatgaattgtcggaagttggtgatggggcataaacaagattccctataatcgttattataaggaacgaaaagaaaaatgcaattattcttatttgttcacccatcattatacctatctgaaaacggcagcaaagatacatatttatttttagtctttttaggaagattgtataaaaaaacaaaatcttagtgggtagatttgaggtaaatcaagtctttttataaaaattggaaaagttggaagattgcagaaaatgcagattcgctttcaagaattttgtcttgctttttctatgtttattgacgtatatttacacaagcatggtatcatgaacttggcttatctgacttctgaatgaaggtttgcgatggctatcgggatgatggtatatcgtgctctatcggagaattcacaaaggaaaggggtatgtcaatgcttggaagattaaaaaagaggagtcatattctctttttcatattgatgttgaatatgagtcctcttttgagcggataaactcctactagattatggagtcgattcggagattgctacataaaaattggtcatgtatgtaggaaattctggtgtcagttaaagaatttttccagtttctttatcatcatacccagacagaataccacgacatgatcgttttctacgattgtagtgttaccggtaaccagtataccttctccgtttctgataagtcctccgatggttgctcctttgggtagccccacatctttcacctgagaacgtgtaatgcgtgagcctgccttaaccgtaaactctgcaacgtcggcattggcgaaggtcagacactttacattcgaaacgtcggcatccagcatcatctgataaatgtgactggctgcaataaatttcttgttgataaccgtaccgatatccaggctctctgccatactgatatagtctatattctctacttcggctacagtcttggtaattcccagtcgtttggctgccagacaggcaaggatattggtttccgaatttcccgtcagtgcgacgaaggcttccgtgtttttgataccttcttccagcagcagttccatatccctgccatcaccgttgatgatcataaccttgtcatctaccagttccgtcaggcggttgcagcgattgaaatcactttcgatgattttggtccgcatgtattccggcatatactgtacggtacgcacggcaatccggctgcctcccatgatcataacgttacggatatcggcttcattctctttgccggctatcttccggatgtaaggaatgtatttctttgtagtggtgaaatacacgatatcgtttagcagaatcgcatcgtcacctcgtggaataatggtttcgtttcctcgtttgatggctacgatgtggaaaggaatatttcttcctcccagctcgtgtaacggaacattcaatatttctgccgtttctctcattttcgttcccagcagaacgagtgcgcctccggcaaattcccaccattgacgaatccagctcatcttgacggcatccacaatctctttggctgccagcatctcaggatagatgagcgaatcgactcccagtttggcgaagaattctttatgtttgggtaacaagtactcgtaattgttgattcgtgctactgtctttttggcacccagactggtcgcaagcatgcacgccgtcatattccggctttcatcgggggtgacagcaataaacaagtcggctcctgccactccggcttccttcaatcccgaaatagaggtcggggaaatgttcacggtaagcaggtcgaaattatttcccaacctgcccagtctttcctcatcgtcatccataaggataatatcttgtttctcacccgataagagtttggccaggtgtgtccctacagcacctgcaccggcaatgataatcttcatgagttcagaatatggattaatgtattatagattcccgtttggtctatgccgcaaatggcgtgtagggcaccgaccggaccatgttggataaaatggtcggggatacccagtcgtttgaccattggggtataattgttgtctgacataaactccagaatggcactgcccattccaccttttagcactccgtcttctacagtcacgatacgggaaaaattctttccgatttcatgtagcaagtcttcatccagtggtttcaggaagcgcaggtcgtaatgtgctatactgcatttctgtgtattttcggtttcggcaatggcctttgccgctgtatttccgataggtcctatcgtaatgacggccagatcggaaccatctttgagtttacggcctttgccaacctcgacagctcccagcggacattcccagtcggtccgtactccccgtccgcgtggatagcggatcacgaacggtccctggtcggggagctgggctgtatacatcagccggcgcagttcttgttcatcgtacggtgaggcaatagtcaggttcggtatcggccgtaagtaagccatatcgaataccccatggtgagttggtccgtcttcacctaccaagcctgcacgatccagacacagcacgacgttgagcttttgtatagcgatgtcgtgtatgatgttatcgtatgcccgttgcatgaacgaagaataaatgttacagaaaggtagcaaaccttctttcgccatacctcccgagaaggttacggcatgtccttcggcaatacccacgtcgaatgcacggtcgggcattgctttcatcaagatgttcatggagcatcctgtcggcatggcgggagttactccgatgattttgtcattctgcttagccagctccagcaacgtcttgccaaatacatcctgaaacaaaggaggcataccactggtatcgtttacaattcgttctcccgtttccttgtcgaatatacccggagcatgccagattgtagcagcttcctcggccggtttgaaccctttgcctttgaccgtatgaatatgaagcagtttcggacctttcatatccttgatttccttcagaaccttggtcagtgacagcacatcgtgtccgtctactggtccgaagtaacggatattcataccttcgaaaatattctgttgctgggcgagcattgacttcaggctgttattaaaccggatcaggcttttccggcgttcttcattcaagactccccactgatgcagctttctggaaatcttgtaccgcagccggttataaccttccgatgtttgcagatgcagcaagtactgtttcatgcctcctacactacgatcgattgccatattgttatcgttcaggataatcaacaggttattcggggtggaagaggcgttgttcagtccttcgaaggccagtcctccactcatggaaccatctccaatgacggctacgacatgacggtcttcttctcctttccgtgcggctgctacagccattcccaaagctacagaaatagaatttgacgcatgtccgcaggtaaatgtatcgtattcactttcggccggtgaaggaaaaggacataaaccgttcagtttccggttggtacaaaagcggtcacggcgtccggtcagtatcttgtgtccgtacgcctgatgccctacgtcccatacaatgcggtcgtaaggcgtattaaatatataatgaagagcaacagtaagctcgataactcccaaacttgagccgaaatgtccgggattgcgtgaaagttcatctatgattttatccctgagctcccggcagacctcaggtaaagactcgacaggaagttgacgcaaatccttcgggctatctattttgttcaacaattcgtaagaaatgggttgttccatccgatctttattcaatattaatttcacaaaaatacgataaatatgtgtattgtgtttacatttgcacaaaaaataatgaacagtgtatacctatggagtttagaacgaaagtagaattgcctgtcggtcaaggagaaattcgtcattcggatccgatattgttgtggggatcttgctttgccgagaatataggaaagctattgacggataataagttccactgtgatgtgaatccttttggcattctgtataatccactttcaatcgcaaaatctgtgtctttattgctcgacaataaggtgtatagtgcagccgatttacgttttgacaagggaatatggtatagcctgatgcatcacagttcgttttcctcggctgaccagtcggagtgtctggaaaagattaatttccgtatggcaaaggggagagaaatgctgggcaaggcaaaatggatgatatttacatggggaacagcacgcgtgtacgaatggaaagagaacggagaggttgtaggcaattgtcataaattgcccgaccgactgtttacacgccggttgctggaggtggaagagattgtatcggcttttgcctctctgcttgaacgcatccgtcaggtgaatccggaggtacagttcctgtttaccgtgagtccgatacggcatgccaaggacggcatgcacggcaaccagctgaataaagccgtgctgctgctggccatcgaaagattatgtcagctattttcgtcatgccattatttcccttcgtacgaaattatgctggatgaattgcgcgattaccgtttctatgccgacgatatgcttcatcccactccgcttgccgtcagttatatttgggaatgcttttatgaaagcttttttactgcggatacactgcgtgtcatgaaagagtggcaggatatacggaaaggtctcgagcatcgtccttttgatgcaaaatcgacagcttattatacattcctaagtcaaattatgttaaagatagaaaagctaaaagaaaaattcccgtacttagacgtacaaaacgaaatagcattatgtcaaactcgattgaagaaataacctccgtcatcggagccaacaggatagggaagcatccggcaactattgactggattcttacagacagccgttcgctgtgcttccccgaagaaactttgtttttcgctctgaagacaaaacgtaacgacggacacaaatatataccggaactttatgccagaggagtgaggaactttgtggtaaccgatgtgcctgaaaatctttctcactattctgatgctaacttcctgcaagtagctaattcgctgaaggctttgcagcgtctggcctccaagcaccgtgagctgtatcaggtgcctgtggtaggtattacgggaagtaatggcaagacagtcgtgaaagaatggatttatcagttgctgagtccggacaaagtcatcacccgctcgccgcgcagctataattcacagataggtgttccgttgtccgtatggatgatgaacgaacataccgagcttggcattttcgaggctggtatatctgaaatgggagaaatggaggcgttgcagccgattatacagcctaccattggagtgctgactaatattggaggagcacatcaggagaatttcacttcgttgcaggataaatgtatggagaaacttcagctgtttaaagactgcgacgtgattatctacaacggcgacaatgagctgataagcaattgtgtttcgaaatcattgcttacttcccgtgaaatagcctggtcgatgaaggacaatgaacgtctgctgtttatcgaaaaaatagagaaggacaatgacggaacaaccgtcaaatatcgttatctgggattcttaaaggaatatcgcataccgttcatcgacgatgcttctatcgaaaattcgttgaatgcccttgctgtagcattgtatctgatggtttctcccgaagatattgccgaacgtatggcgcatctggaaccggttgccatgcgtctggaagtgaaagagggtaagaatggctgtgtcttgataaacgatagttataattctgattttgcttctctcgacatcgctctcgactttatggcacgccgtacagaagacaaagcgcgccggcgtacactcatcttgtcggatatactggaaagcgggcagcccagcaagcttctttaccgtcaggttgccgatctggtacacagccgtaaggtagaccgtatcatcggagtgggagaagaaatctctgccgccgctcctcgtttcgagatagagaagcagtttttccgcacgacggccgaactgatagagtcgggtgtgctcaattcattgcgtaacgaagtcgtattgataaaaggtgcacgtgcctttcatttcgatgatataaccgatttgctggaactgaaggtacacgaaacgattcttgaaatcaatctggaagctctggtcgctaacctgaatcattaccgtaacaagctgaaaccggataccaaaatggtgtgtatggttaaggcttctgcctatggtgccggttcgtttgaggtggcgaagacgctcgaagaccatagggtggattatctggctgttgcggttgccgacgaaggtgccgacttgcgcaaggcaggaatcaacagttctattataattatgaatccggaactgacagctttcaagaccatgttcgattacaaactggagccggaagtctatagctttcacttgctcgaggagttgattaaggcagccggacgtgaaggtgtttccaatttcccgatacatatcaagattgatacgggtatgcaccggttgggctttgctccggaagaaattccttatctggtagaccgtctgcaccgtcagtcggcagttattcctcgttccgtattttctcacctggtgggaagtgatgccgagcgattcgattcctttacacgtcgccagattgaaacattcgaagctgcggcggccgaactgcaagctggattcagccataagattctgcgccatatctgcaatacagcgggtatcgaacgttatccgggtgctcagttcgacatggtacgtctgggtatcggattgtatggtatcgatccttttacaaataagatcctgcataatgtaagtacgctgaaaacgactatcttgcagatacacgatgttccagccggtgaaacggtaggatatagccgtcgcggaatcctcgaacgtgattcaaggatagctgccattcctatcggatatgccgacggattgaaccgtcatttaggcaacggtaatgcttactgtctggtaaacggacaaaaagcgccttatgtgggcaatatctgtatggatgtatgtatgattgatgtgactgacattgattgcaaggaaggcgataaagccattatctttggcgatgatcttccggttactgtgcttgccgataagctcgatactattccttatgaaattctgaccagcgtttccaatcgggtgaaacgtatttatttccagaattaattcgtacggaatctttttaagatatttgtttttttagaaatccttgcatgcggagaatgtatgcaaggatttcttttttgtggaaataggtcagttattgcacctcaaagcttaaaaaatgaacatagttgtcggttccttctgctatttttgttatccgtaaaaagtatgtttaaccgaagaacagatgttcataatatgaaaaacgtaaaatctttgttcctgaaaggagcatttgtctgtatgctgatgttttctgcattgccttcttctgccgagaattatccttatcgcagcgatgtactgtgggtaactgtgcccgatcatgccgactggctgtataagactggcgaaaaggctgaagtagaaatacaattttataagtatggtattcctcaggataatctggaggtgacgtatgaattgggaggggatatgatgcctgccgagaagaccggttcggtaaagctgaaaaacggtcgggcggtcattgatgtcggaacgatgaaaacgcccggattccgtgactgccgtctggtagctatcatagacgggaaggtttataagcaccacgtgaaggtaggtttttcacccgaaaaattacagccgtatacgcagcttccggctgattttgaccagttctgggagaagaatctggcagatgcagctcgttgcccgatgaaatatacgattgaaccggctcccgaatatgccacggagaaagccgattgttacctggtcaagctacaatgtttccgtccgggttcgtatatctacggttatctcactcgcccgaaggcaccgggaaagtatccggttgtgctttgtccgccaggggcaggtataaagacgatcaaggaacccaagcggcatatctattatgcagaggaaggatgtatccggctggaaatggaaattcacggcttgaatccgaaaatgtctgccgaggagtttaaagagatttcttcggcttttggtaattatctgagcaacgggctcgacaaccgcgataattattatatgaagaaagtctatatgagttgtgtccgggctatcgactttctaacttccttatcggactgggacggcaagaatgtgattgttcagggaggaagtcagggaggagcgcttgcgcttgttacggcgggactggataagcgggtgactgcttgtgtgacgaatcatccggcactgagcgacatggcaggatacaaagccggacgtgccggaggctatccgcatttcttcaagaattatcagggaatggatacaccggagaaaattcgtaccatggcttattacgatgtggtgaactttgcccgtcggataaaggttccggtatatattacgtgggggtacaatgatgatacgtgtcctcctaccaccagttatattgtttacaatgtactggactgtccgaaggaagcacttataactccgataaacgaacattggacttccgatgttacggaatacggacagttgaagtggattcagaagcatcttaaatgaggctgtatttgcaggagaactttcaggctttatcctccgctacagcttcaatcaatattggctgaaactggcattcccttgtttcttgtctagggttgaaaaaactgacaggcagaagcaagggtatttcttatgtagagttgtaggaacgtgtgcaagtttatctgagtttttgtacaaaagattttggaatttgtacaaaagataatttttttttgagcaaatgcaatcggaaatttcaccttgtctgtggaggaagaagcataaaaatcccctttatcttcctgacgattgctgtttcttgtcgggcaagcgtccgaaaataaaggggaaagagtattttacttgttgttatgtattataccttaaccagtttgtatttaggaaccagtactttcatgataatccatcctatcagataagctacggcacagatactgaaaataatgaagtagccggcagctttaccttcaaatcccatgaacgtcatgttggtttcggcagcatagtcgaacagacgtcctgatcccatgttgatgaagaatgaaccgatacctccagccataccgccaattccgataatggttgcaatggtactctttgggaacatatcaccaaccaccgaatagatgttggccgaccacgactgatgtgcggctcctgcaataccgataatgataatcgggaaccagtatgagtagttgcccagcggctgtgcaaataatgccagcagcgggaacagcgcaaaaataaacatggcctgcatgcgtgctacatacggattcttgccagtcttgttgataatgatggtcggcagtttacctccatagatggaaagcatggtgatggcatacaagacaaagataagcatctgggcagttgctgtatcggaagagaaaccgtatacatccgaaatgtaggccggtgtccagaacagatagaaccaccaaacgccgtcggtcatgaatttaccgaagaatacagcccacgtctgaggaaacttgaagcattgaaggaaagatatcttctgattgtcgaagtcgctgtttgcgctttgtgcctcggctttgtttgcttcaggatcgttgttgtcctgttcgatgtatgccagttcggctgcattgacatgcggattggcatgcggcttcttgtagaggaacatccacaatcccatccagatgaagcccagtccaccgataacgacgaatgccatttcccatccgttgcctacaccgatactctggaagtagcgtgccaaaggaggtatgctgacaggggcaatcaaagctccgatagtagagcctgcattgaagatggaagttgaaaacgcgcggtcttttttagggaaatattcggctgtaactttgatggcagcggggaagtttcctgcttcgcctgctcctaaaacgatacgggctgcgatgaagtaataaacgctggtgatggcaatggttgaggctacggctcctgtagcagaaagcatgtcacttgcgttgtgagcaccgatcgtcatctcggtagcccatccacacagcgcatgcaggcaggctccagccgaccagataaaaatggcccaaaggtaaccctttttcgttcccatccagtcgatgaatcgtccggcgaaaaggttggcgatggcatatacaattgaaaatatagctgtgatatctccgtagttggagtcagtccagtgaaattccggagcgataaaatccttccaggtcagcgaaagaacctgtcggtcgaggtagtttacagtagttgcaaaaaacaacattccacagataacccatcggaagttggtcattttttgttctactttctgaaatgtattcatggtattaattgaaaatttacataagttgacgatataaaaagagtcattccggatgctgccgatcttcctgaaaaatgaagatcacaacatccggcgttggcaaaaagatctgttgttattgaatcactggagaattcatctcatttcagtataagatatcttgtccatatctccgtagtccagattttctccggccattccccagatgaacatgtagttgcttgttccggctgcggcatggatagaccattcaggcgacataatagcttgttcgtttgccagccatactagtctttcttcctgaggctctcccatcaggtgacaaatcatgttacccggagtcaggttgaaatagaagtatgcttcaatacgtcgggagtgggtatgtgcaggcatcgtattccatacgcttcccggtttcagttcagtcaatcccatttgtaactggcagggaccttcttcgagtacattacttacaattaactgattgatgacacggtcattgctttcttccattttacctgcagcaaacgaattggctttcagggaacccttacgtccgtccagtgtaacgagctgtgtcttgtaagctttatgagcgatagccgaatttaggtaaaatttggctggctttgaagcatccttactcttgaaggtaactttttggttgcctcttcctacgtaaagagcttccttgaagttgagggtatattcctttccgtcgacagttacaattccttctccgccgatgttgataattcccagttcacggttgaaaagaaagtaaggagccttcaactggtcgatggtgtcgagtgtcagttccttgttgacaggaacagctcctccaaagataaagcggtcgtacatagagtaagtgagattgatttcatcggcaaccatcactttttccatcatgaaactgctgcgcagtttttgagtgtcgtatgtctttacgtcctgcgggttgcatgccacctgcatgtgtacgctggaaatctgggcgtttgcgctaacggaggccacgccaagtatcattgcgatagctaactttttcatatttcttattttatattgttattttattgattctttaggtctaattatccctgacggctttctttgataatccgtcttctgttgaagatggcaagtgccagtgtaccgatgaccagaacagcggaacctattatcttcaggttgtatatcaggtggaaaattatccacgagaacaggcttgaagcaaagtcgagtgctcccccttgaaatccttctggtatctttacggccgaatcgcctgtcttggcaaagacatcttgtgcagcctgtgtgaagaatggtgcaagatcggtcacgaaataaagtccaacgataagtgctaccagtccgataatgaatgttttcagaacattacctttggtaataggcagaacggcagggaacaaatagaacattcctgcaagcgaagccaaaggcaggaactggtttccaggtaagacgacggaaagaaacaaggttaccgggatgagcagcaacgaaaccaccagtgtggtaggatgtccgattacaagtgccggactcataccgatgttcagtcctgccgcattcttgaatttgcgtgcaatcagttcgcgtgtggcatcagaaatcggtcgcagtccttcgatgaagagcgaagtgatacgaggaataagttccatgactgctcccatcttgatgcctaatcctaagatagaaggaatattgtctaccagctctttgctgttctcgcaggcaagagctccgatggcgcatcctacaatgactcccagaaacaatggctctcccatgattccgaactttttcttcatgccttctgcatcgatgctcagcttctcgaatccgggaattttgtcgagtaccttattaattactacggcaaatgggacaaaaccttgacagaacggttgaggaatggagattccttccatcttttcataatatgtctgaaactgcttgcttgtgaggtctgccataatcaatgtaatgatataacaaatgattgcagcaaagaatccccaccatatattatccgatgcaaaatacacgactgctccgataaatgcaaaatgccagtagttccataagtcgatattgaccgtctttgtcgttttggtcagaagcataataatattgatagccaaacatacggggatgatgaatgctcctaccgaagtgttgtatgctaccgatgcagcggccggccatcccatatcaaaaatgccaaggctcagcccgtagatttcggtcacttttttcaacggatctcccaggctgcttgtaagcaatgctgttacgacagacaagccgacgaatcctactcctacgagtaggccgcttttcaaagccttgccgaatttaattccgatacatactcctaaaatcgtaaaaataataggcatcatcactgctgctcccagaccaatgatatagctaaaaacttgttccataatttgcttttgtctttcaataaatagtgatgttagggttaattatacatttagattgcttcaaaaataagttcttttcttttaatttgcaatcgaattctaattttattcgaaactttaatgaaatagacaaggaaaaaccgttatcgtacacgattattccatattggtgaataataaatctacctttaaactcaaaatttctacatacaagtatttgttttttttctacatttgtacataaaaaaactgaagtcgaaacatgaaaagcaaacgaattctaatgggatgcttaggagttatgcttgcagttgttggcatagctcaggtgcaagatagttttccaaaaaatcagaaaccatggtcggtacggatggccgagtcggagatggttcgtaatccggaatcttggcaggtagattttcagccttcgcttaaatgggattattgccatggtctggaattaggagccatgatggatgtgtatgatcgttatggcgatgccaaattttacgagtatgccttagcttatgccgatacgatggttaacgaggacggtacaatcaagaaatataagcttacggattatagtttggatcgtatcaattcgggtaagatgcttttccgtatttatgaacaaaccaaaaatgataaatacaaaaaagcattggatttgttgagaagtcagttcgacgggcagcctcgtaatgccgacggtggcttttggcataaaaaagtttatcctaatcagatgtggctggacggactttatatgggaactcctttcttggcggaatatgcttatcgaaataacgagccgcaagcttatcaggaggtgattaatcagataaagattgtagctcggcatacgtatgatccggctaatggtttgtttcgtcatgcctgcgatgtgagcaaacgggaaaaatgggctgacaaggaaactgggcagtcacagcattgctggggacgtgcgttggggtggtatatgatggccattgtagatgacttggactttattccgcagcatgaaccagggcgtgacacggttttggtgatactgaatcatattgctgaaacgctgaagaaatatcaaagtccggagggtttatggtatcaggtgatggataagagtggagagccgggtaattatttggaatcttcatgctctgctatgtttgtttattcgttgttcaaggctgttcgcaaaggatatattccgtcttcttatttcgctgttgcacgaaaggggtacgaaggtattctgaatgaatttattaaggtggatgataatgggctggtttccattacaaaagcttgtgcagttgccggattgggcggaaaaaattacagaatgggcgattatgattattatatccatgaacagattagggataatgacccaaaggctgtgggtccgtttattctggcaagtctggagtgggaaggactgccaaaggagaaacgccggtttgcggaacccagggaactggttgttgcccaggatggaacgggtgattatacgacaatagctgaagccttggaagctgttcgtgcctttatggattttgatgtaaagatctatataaagaaaggtatatacaaagaaaaacttgtagtaccttcttgggtgcaacatatagagttgataggtgaagatgtgcagaatacgattataactcatgccgaccatgccaatatgaatcacatggggactttccgaacgtatacggttaaagttgagggtaattatattaccttccgtaatattacgatagaaaataatgctcccagactggggcaggctgtagctttgcatactgaaggagattgcctccgttttattaattgccgttttttaggaaatcaggataccgtatatacgggagtggaaggtactcgtctgtattttgagaattgttatatagaaggaactacagattttatttttggaccttcgactgcatggttcgaagggtgtacgattcatagtaaagctaattcatacataacagcagcttctactcctaaagatatagagtatggttatatatttaataaatgtaagttaacggctactgctggggtcgataaagtatatctgggtagaccttggcgcccctatgcttatactatctttatgaattgtgaattgggaaagcatattgtcggagctggttgggataattggagagatgcgaagaacgagaagaccgcccgttatgctgaatatcacaatagtggcgagggtgcaaaagcagataaccgtgtgaaatgggcaaaacagctttctgataaagaagctgagaaaataactaccgtgaattgttacaatttatcgaaaggatggcgattatttgaataaaacaatttttacgtttttaaagtcaaaaaatatacatgaaagatgtatgttaagaagaaatttgtgaactaattttaatattctaaaaacacatttattttatgcattatcaacagagaataaggaacgtcgtctctttacttattgtgagtatgctttgtcttgcttcttttgcacaagggttgcaagtgcagggtattgtaaaggacaaaaacggtgaacctatgattggggtcaacgtggtagtgaaaggtacaactaatggtaccataacaggtttggatggtgacttttcacttagtggattgaaaaaatcggatgtcatctcgtttacttatattggttttaagacgaaggatgtgaagtacggaggacaaaagcagcttgatgtagtgttggaggaagatacggaaactctagatgaggttgttgttatcggttatggtacggtaaacaagcgtgatttgacgggttctgttgcatctgtcagtgctgaagatattgccgccgttccagtttcaagtgctactgaagctttgactggtaagttggcgggtgtaaatatcacaacaaccgaaggttctcctgacgctgatgtgaagattcgtgttcgtggtggtggttctctgtcgcaagataattctccgttgtatatcgtcgatggattccctgtttcaagtatcagcgatattgcaccgtctgaaattcagagcatcgacgttttgaaggatgcttcttctacagcaatctatggtgcgcgtggtgccaatggtgttatcatcgtaacaacgaagagtggtacggaagggaagactcaggtagactttggcgcttctttcggcttgaagaaagttaccagactgactaaggttcttgatccttataattatgtagcttatcagcatgagctgggttctacagattatggtaattattcagatatggatatctggaagtcggttgagggatatgatttccaggatgatatttttggacgtaccggaaatcaggctcagtataatgtgaatgtaagtggaggtagcaaacaaataaaatataatgtaagctatgctcataacgatgaaaagagtatcatgctgggatctggctttaataagaataatattaatgctaagattaacgctgaactgaatcaatggatgtcgttggacttcaatgctcgtatgagttacactaccatcgatggtttgagtggtggtgctgataccaatgaatcgagtgctgcaaactctattgttgcaaacgccgtacattttcgttctgttgatcctttgacttcaaatactgatgatgaaagtaacaatacttcatcgcaaaaaaatccgttggaacgtttgctggctacttataagaaaagaaatacattcaatcagaattataatgtaggtttaaactggaaaccattcaagaactggacattccgttctgaatttggttacggctggaaatacgacaacactgatcaggtttggtctagcgatgctgttcagaattctaagttgggatataacggacaaccgcagtctgtttttacgcgcgatattaccaagaactggcgtaacgctaacactttgacttacgataataagaaactgtttggcgggcgtgataaactgaatgtcttgctgggacatgaagtaagtagcagtcaggaaacatcgctcgaaaatacttctgttgcattccctactactatgacaattgatgaagttctggctaatatgggagcaggtactgcgttgcctacgcaaactaccatttctgcaaaggataatatgttatctttcttcggacgagtaaattacactttaatggataagtatctgttaacggtaacggtccgtgccgatggttctagtaagtttgcaaaaggtaatcagtggggtgtatttccttctgctgcgttggcatggcgtttgtcggatgaggcatttatgaaaggtgcacaggactggctatctaacttgaaggttcgtttgagttatggtactgctggtaataaccgtatcagctctggtttgatgtatactacatatacaatggcaggcaatacaggaaaagctcctttctttgatgaaagtcgtggtgctatgctggaacatggctctaacttgtataacccgaacttaaaatgggaaacaaccattacacgtaaccttggttttgattatggattcttcaacaaccggttgtctggatcattggatttttactggaacacaacaaaggatttgttgatgaaaacagaaattccgtctaatacgggttatagctatcaatatcagaacttcggtaagacttctaataagggtgttgaattgactttgaatgcagttttggctgacaaagcaaaatggggattgaattttaactttaatatttcttataaccgtaaccgtattgatgaactgggtacagagaatccttggcagagtagtaactggtcgggtagcactattgcaaaatacgaagattaccgtgtagaagaaggtggtcgcttgggtgaaatatggggatataagacaaatggtttctatactgcatatgatccggtgacaaatccgaatggtgaactggttttgaatggtacttcatgggcattgcgtgatggtatcaaggataacagctattcattggcaggtggtaaaccttatcccggacagctgaaatatgaatgtgatgaaaatggtgatccgattaagcagaaattgggtaatacagttgctccgctgacgggtggattcggttttgatggattcataggaaacttcgattttaatatcttctttaactattctgtaggtaatcagattgtaaacggaacgaaactggctaactcattctgtgttggttcttcaaaaggatataatttggtaaacgattttgctctggataaccgttatacttggattgatcctgaaactggtttgaatttaggtaagccagatggttctacagtcgactactatggtggtgctgaaggtttgattacacgattgaacgcaatcaatacaggagcaaatatctataatcctgctgctgttaccgcgatgtatctgaacgattatgctgtagaagacgcttctttcttgagagtgaacaatattactatcggatatacattcccgaaagcttgggtgaagaaagcttttatgcagaacgtacgtatttatgtcacaggttataacctttactgtctgacgaactattccggaccggatccggaagtagatacaagcagcaagaagaacgcaatgactccgggtattgattatgcagcttatccaaagagccgttcttttgttgctggtattaatgttacattctaaattctaatatgatatcatttatgaaaaatataattaagttattagctttagccacgggagttgcaggtatgagtgcttgttctgattttctagatcaaactgctccttccgaactaaatgacaatactgtatataattcaacttattatacaggattgcgtgtgaataaaatttatggtggattggcgcaggaccagacttattcacaatacatccctattgtatggggattgaactccgattgtgaactggtagatggtttgggggccgatgctgataatacgactagtgaacgtggtaacatgaactacaatgccagtccgtcgtggggtaatctggccaagctttgggacgccatgtatggtattatagaagatgcaaacttaacattggaaggtatcaactccagttcattgcttacagctggtggctcggaacaagcggctatggaacgttataagggagaggctttaaccttgcgtgccatgatttattttgatctggttcgtttctttggagatgtacctttgaagctggaaccttcgcaggctgatttgagtaatgcttatttgcataagacagatcgtgatgtcattctggatacgttaatggtcgatttacagactgcaactaaattattgccgtgggccgatgaggtttccggttatactacagaacatgtaacaaaaggatatgcacatgctttattagcgaacattgccatgactcgtgcaggatgggtgattcgtgaaaaggctaaagatggatatgaaacagccgactatagtgatcctacttatccgactcagcgtccggatgctgctacacgtaccaaactctatgaattggcattattcaatttgagtgctgttattacaaacggaacacataaattgaatccgtcggtagaaaatcaatggtatttaatcaaccagcgtgaactggataagaattaccatgagaatatttttgagattccgatgggacttggagttagtagtgaattaggttataccgttggtgtacgtgtgaatggtgctacgacagaatatggtgtaaagggtaattcatcaggtaagatgaaactgactgcacctttcttctattcattcgacaagaaggatttgcgtcgtgatattacttgtgcacaagtacagctgggtgcagataacggcgttaccaaagaatccatgttgggtaatactccgtttggtatctatgtcggcaaatgggatatacgcaagatgaatgaggaatggcgtcaggctgctattgcaaccggtaatgcaaagtggatgtcgggtattaatgtagtgagagcgcgttatcctcaagtgttgttgtggtatgctgaagtgatgaacgaactggctggtcctgacggtgattatactggatctgcaggcttgacagcccgtcaggcattggctttggtacatacccgtgcgtttgccgatgcagataaagctgatgctcaaaaatacatagatgcaatacctgctaccagggatgctatgtttgatgcgattgtggatgaaaatgcatgggagctggcaggagaaggtttccgtaagttcgatttgatccgctggaatttgttggctgaaaagattcaggaattcaaagatacttattacaatgaactgatggatgaatcgaatcctaattattacccggaaaaggtttactttaactataccgatgataccaagactaagattgatatgtcgagtgttacttggtatggtctgccggagggaaaagagtcatccgattacgatgataataagtcattctatggtgcagaaagagatgattctaaacagactcagttgcagactaactggccttctatttcaagtggactggttggaactaatgtacaggtgaaaaaccgctatttgttgcctattggatctacaaccatttcggctgcaaacggttatatccataactcttatggatactcagattaatattcaacataaaattggcatagaatatgaagatatttaaatatattgcaggttctggagcatttatgctcctgacctctatcatcggaacggcatgtaccgatggtaatgattggaacgtagatagcacacacgaccgtttgtttagtgtgacagcttcagacatatcggtttcggctaaaccgacgtctgcggaagtttcatggagagtagttcctgatgcagagtattatgtgatggaatatagtacggactccttatacgatgagatagcaatgggtggaactgaacattctgttattttaggagaagataagtccattgttgagagtccttatacgattaccggcttgcagggagaaactaaatatttcttgcgtatcaagtcaatgtcttctgcgaaggctgattcaaaatggacgtatttggaaaagtattctttcaagacttctgcagagcaaattttgaatgaggtcgcttcaattacgggtgaaagtgctgttctttcttggacggaaggtgctgaagttactttgttgaaattggcagaggataaagatgatgtagaagaagtggatactacatacattaatttggatgctgcggcggtagctgcttcatcgtatacgcttacaggattgtcacctaagacgaaatattctgtttctatctataatggtaatgtaaaacgtggtacaagaacctttacaacgactgaatcttatccggcaggttatgatattgtaaatgtaactgatgctgaaatgctgaacgatgtatttagcaatccggctaattacatacaggagaacggtggtaatgttgttttggtatttgcaaatggatctactaccgattacatgggtgaaagtatggaactgacaatcccggctgaatttaaatctgttatcttctggggggaatcgggcgatacaaaacctgtctttatgcctaagggactttctatggcaggtagtcatgatttgatccgtttctacaatttggatctgcagaatacaagtagcggaagtgactacatcgtgaactttaatgtagaaggtaatgtaggtgaaatattgattgataactgtaacattagtaagactcgtggtgtagttcgcgttcagagtgatggtgccaaaggttctatcggttcaattaatatcgataactgcgtattgacggatattggttcgtatgcaattgtacagacgaaagtttccggctttacactcaattcgatcagcttgtctaattctacaataagtacagtaaatgccggtggagttttgataacccagcaggataatgtcaatatctcaatcgatgcttgtacgttctataattgtgtaactagtggtaagtcatttattgatattaataagatgtcgaacgtaactgttgatgtcaagaacacaattatcggtcagttgtatagctatacaagtggttcgactatcaaggctacaagtgtgaaaaatattgctacgacaacaaatctctttactacaaccgactgtccatataacagtggttacgaatggggcgaaatgttgaatgtatcatctaccgaattgttcgtaaatccggctgaaggtgacttccacatacagtctgcaagtcagagtgatgtagctggtgcaggtgacccacgttggaatgaataaaacttgtactgaaatgtaagtgataaataacaagtccatagataggtatatgcctatatatggacttgtttttattttaatttcatatatttagacctgaaaatctgctatagaaagatgaatgttattggatttgtaaagcaatcgtgtatgattgttgctctattaagtggactgggcatatcctcctgctcggaacaaattgttacacaagaaacaaatagtgaagtgcaagtaccggaagaagatttgcctgtttatcccgctccggatagaagcgctattccagcttttcccggggccgaaggcgccgggaagtatactacaggcggtgccggaggttctgtttatgttgtcacttccttaaaagacgacggatcagaaggtacgctacgctgggccgttgaaaaatcggggaagcgtacggtcgtatttgctgtaggaggagccattgcactgacgaagcaactggttataaagaacgatgatctgacgattgccggacaaacggctcctggagcaggaatttgtctgaaaaattatactttacgtatcaatgccaataatgtgatcattcggtttatccgctgccgtatgggagatgaatgccagacggaagatgatgcgatgaatggttatcagtcgtcgtatcccggaaagaaaaatattatagtcgatcattgttccatgagctggagtaccgacgaatgtgcttctttttatggaaatactaattttacgatgcaatggtgtatcgtcagtgaaagtctgaccaattccattcatgtaaagggaggacacgggtatggtggcttgtggggaggtagtcccgctacattccatcataatctgttggctcatcatagtaatcgtactccacgcttgtgtggcagccgttattccaaccgggcagatatggaaaaagtcgacttgtgcaataatgtaatctataactggtcgagtgaaggggcttatggggcacagggaggctcttataacatcatgaataactattataagccgggtccggtagcagttcccaagaaagtacattgccgattctttacagcttatgttgacgatggtaccaacaatcaggctgccggtatatatggtaaattctatttgtccggcaactttatggatacccgcagcgacttgtcgaagagccagctagcagaagtggaggctgcaaatgcagataatacttcctctacagcttttgtggtaaagaataatgaaatgtccgctcaagacatgttggttgcgcagcgctttgatattctttcggactattctttcatgcagtcggctcaggaggcgtacgaagctgttctgaactatgcaggcgcatccgataaacgggatcagattgatacccgcattatcaatgaaacgcgtacgggaacgtattcccgggaaggttccaatggtagcagctatggctttatcgatacacagaaagatgccgaagaatgggatgaatacgttgaggcacacgcttccgaagttgattcggatggggatggtatgcctgatgtgtgggaagagaagaacggcttgaatccggcggataaatcggatgctgctacatataatttaagtaaggaatatacaaatctggaggtttatataaatagtttagtcgaaagcctgtatccggctttaaaataaaagtgttttatgaaaaagatattaatgggtggactttactgcatgttgttggcaggaacgttatcgttgcaagcacaagagttgaaatcatatccggtaccggaccgttcgaaagttcttgctttcccgggagcagatggtgccgggaagtatactacgggtggagcaggaggacaagtcttgattgtcacgtcattgaaagacgatggctccgaaggtaccttgcgctgggcccttcgtaagaaggggcctcgtacgattgtgtttgccgtgagtggtatcattgagttgcaatcaccgctcaaagtcagtaacggggatgtgaccattgccggacagacagctccgggagatggtatctgtctgagaaattatacttttggcattcaggcagataatgtgattgtccgttttatccgctcgcgtatgggagcagatatcaagcagaagggcgacgatgcaatgaatggattcaagcatcatcgtaacattatcatcgaccattgctccatgagctggagcacagatgaatgtgctaccttctacgacaatagtcagtttacgcttcagtggtgtatcatcagcgagagccttgccaactctatccacgagaaaggggctcatggatatggaggtatatggggcggtcagggtgcttcgtttcatcataatctgctggctcatcacacaaaccgtactccccgtctgtgtggaagccgttatacgggacgcccgcaggacgaaaaggtggaacttttcaataacgtgatttataattatggaagtgatggagcttatgccggcgaaggaggaagctataatttcttgaacaattattataaaccggggccttatactgctacaaaatcttcttataagcgtttgtttaccgcttatcccgatgatggaacgaacaataatgttaagggaactcatggcgtcttttgcttttccggtaactatattgatcctacttgcagcaagctgactgataaacagcgtcaggctattatgaaagtcaataagaataatgcaatcgggctgatcataaagaatcagtttgccccacaaagtgaattgttggttcagagtcctttcgacattgcagagcatgttactcttcagcctacctgggaagcttatgagtctgtcctgcaatttgctggagcgtcttatcggagagatgcgtacgacaagcggattgtcgaagaaacccggaaaggaacttatacctatgagggaagtcatggcagtacgaatggcatgatagatcagcccagcgatgtgggtggatggccgaaatatcaggctggagaagctcctgttgattccgattcggatggaatgccggatgaatgggagaaagctcacgggttgaatcctcatgatgcgtcagatggatgcaactataacttgagtcccgattatacaaacttggaagtttatctgaacggactggtacagcatttatatccggatacagaaaaatagcatttgatataaaaatctcctcgtttctgttggggtgttatcgctcaaacgaaacgaggagattttttatattccatgacaattccttatcactggagaaaggtttccttgccagttattctgaagttgctgtttgcttttcgttgataatatactcatttacatgctaaatgtcgctattttggttaaataataaccataatagaacaattattccctttcttccccttggatttttcctaaatttgaacacgaatcaagcttatgtaatatactatgaagaagaaatatttcttgatgtgcttgctgatgggagcaagtacctatacgttggctcaaacctttccttctacagaagctttcagcgatggaatccatcactggaatctggagcatagcgaacggaattacaaacgttatccggcggagcagtatgtaaagattgccgataatctggttgcttaccagaatgaagatggaggatggcctaagaacattgactggatggcggagcttccggccgattctgtagtcaacagtttgtcggagcattatcgtcagagtacactcgataatcgtaatacgtattctcagattgaatatttggcgcaagtctatacactgaccaaaaagcgggtatacaggaaagcggtactcgacggactggaatatctgttgaaaacgcagaaaaagaatggtggatggcgtggatgggatgtcgatgccattacgttcaatgatgaagtgacgaccggggtgctgcgcttgttcctgcacatcaacgaaggagatttgaactttacctggctggacgatacgatgtgcaagcgtatttatcaggcattcaatcggggtattgacatgattttgcggacgcaatatgttcagaatggggtaaaaaccgtgtggggacagcagcatgataaccagaccttgctaccgacgggggcacgtacgttcgaactggcttcactgacggctggcgagagttgtgatgttgtccggttactgatggagataccacacccttctgatgaagtgattgaagcggtaaagtcggcaatggcttggttcgataaagtggcgataacaggtatacgcgtagagaaggtttccattcctgcggatcagattgtgaaccatgaatatccgtacgatcgggtggtggttaaagacaagaaggctcctcgtatctggtcccgtttttatgagatggcagacaatactccgtttatgtgcaatcgggatggcatcaaggtctataagttgtcggatgtaaagctggagcgtcgggttggctatgcctggtatacgtatgcgccggaagagctgttcgaagcttatgacatttggtcgaaaaaggtagaggcggaaaaggcttatgcaggttatgaggtacaggataatatgccttcattctatgaacagctgaagcagagcctgacttatccgatggcatggggaaattcgccggaaaaagatttcagtaaatggcgggaggaggcacgtgaaaaactgctggaatgtatggatcccgctcctccggttgttccttacgatatgaaagtgctggctacggagaagcgtaaaggctacgaagtgcagaaaatagttttcaatgtgtcgggatattcgcgtgttcctgcctatttgctggtaccggaaggtaaaggaccttttccggctgtgctgcttttgcacgatcacggagctcatttcaccatcggaaaagaaaagatggttcgtccgtttggcgtatcggatgttgtaatgaaagatgcggacaactggtgtaagatttgttacgacgggcagtatgtgggcgattatctggcagaaaacggttatgtcgtgctggctttggatgctttgttttggggagaacgcggacggaaagaatatgcacgctatgattctcagcaggcgttgtcggccaatttgttgcaaatggggatgtcgtggggaggattcatcgcatgggatgatatccgtagtgcggagtttcttgcctctttgcctcaggtagacaaggaaaaggtcggtacaatgggattttcgatgggagcacatcgtgcatggatgacgatggcagctaccgatgtggtcaaggcgggagcggctgtatgctggatgaatacgacagatagcctgatgacgttgacaaacaatcagaacaagggtggttcggcctatgccatgctgatacctaatattcgccgttatatggactatccgcatgtcgcatcgattgcctgtccgaaaccgatgttgtttaccaatgggttaaaggataagctttttccggtggagggagtgaaagccgcctatgaaacgatgcataaggtatgggacggtcagggagcaggtgagcatttgcagaccaagttttatgatttgccgcatttttgcagcaaggagattcagcagacaattctggagtttttcaatagggaatttaatataaatcagaaataacaagaacatgaggaagattcaatttgtatggattgcactggctgtcctgctcttatcggcgtttaagtcggaccgtgtgattacggtctttatgattggtgattctaccatgtcgaataagcctttggaaggaggaaatcaggaaaggggatggggacatgtattgggaggcttctttacggaagatgtgcgggtagaaaatcatgcaatgaacggacggagttcgaagagctttatcgacgagggacgctgggaaacagttgtcaacaagatccgtccgggagattatgtctttattcagtttgggcataatgacgagaagccaaatcctgaacgacatactgatccgggaacgactttcgatgagaacttgcggaagtttgtgcgcgaaacgcgtgagaaagggggaattcccgtattgtttaattcaatcgtacggcggaattttggtgtgaacccgaatgctgtgacagccgacgatatgcgtccggaaaaagatgaggctgtagtagaaggagatacgctggtcgatactcacgggaaatatttggattctccacggaatgtggcaaaggagatggatgtctgctttatcgatttgaacaaggcgactaagcagctggtagaatcgtatggagtggagggatctaaaaagctttttatgtggattcctgccggaacgtgtgtggcttgtccgaaaggccgtcaggataatactcatctcaatgtatacggtgcccgcaaggttgcggcacttgctgccgaagctatacagaagcagttgccggagttgggtaaatatgtccgtttctatgactatgtggtggcgaaagacggtagcggagatttctttactgtacaggaagccgtgaatgcggtgcccgattttcgcaagaacaagcgcacgaccattctggtgcgtaagggagaatataaggaacgggtgattatcccggcatcgaaaatcaatctctcgctgattggtgaggacggagctgtgctgacggatgatgcgtatgccgcgaagaaaaactgttttggtgaggaaatgtctacttccggttcgtcgacggtctatatttatgctcctgatttttatgcggagaacattacgtttgccaatacagccggacgggtaggacaggcagtcgcttgttttgtagacggcgaccgggcttatttcaagaattgccgtttcttgggtaatcaggacacgctgtatacctacggaaaagacagccgccagtattacgaaggatgctatatagaaggtacagtcgactttatctttggctggtctaccgccttgttcaaagattgtaccatccatagtctggggaatggttatgtaacagctccttctacggatgaaggaaagaaatacggctatgtattctggaactgccgcctgacgggagccgacgaagcgaaagcggtttatctgtcgcgtccgtggcgaccgtatgcgcaggctgttttcatccgttgtgagctggacaagcatattttgccggtcggatggaacaactggggaaagaaatcgaatgaggctacggtcttttatgccgaatatcagaataccggagccggtgcggccactgccgagcgtgcgtcttatagtaaacagttgaaggatatttctgcttatcagccggaggaagttctgaagggaacggatggatggaatccgattgccaacggcaacgctttgcttacaaacttgaagcggtaagtctttacttttttcttgcaggaaaacgtggcggggaatgtttgggtttctcgccacgtttttgttaaaatgtcgggacgttttttatttttttgtacaaaagattttagaatttgtacaaaaaacgacacggacttgtgcaggccttttcttgaacctgcgcaagtccgtgtcgttatatcatccgccatcagtctttgatgccgaacagccagcggaagaaacgtacaaagatattccgtttcttcggtttgtcggccggagtatcggtggcaggcttgagggcagtcgagtcattttttacaacggtggagtcgttcaggattgtcaaactatcagtctggaatgacagactatcgcctttcagcaacagagaatctcgtttaagttgtactggcatttgcttgatagaatcacctgataagcctaatagcttcaacgagtcgtttgccaatgaatctgtagggattgtatctttgggagttgcagaagttttgacaggagttaccggcttttggggagcaggtttcggcttttctatcttaaactgtaccggaacggaatacttgcaacgtactctcatgccactttcacgtgcaggaatccagttgggcatctggcggatagccgtcagtgctgccgagtccatatctgcccgcaagctgcgaacaactgtcggattggtaattgttccatccttttctaccacaaactgtacggcaactacgccttccagtttttctttcttagcttgcggaggatataccagatgatgcttcaggtaattcaagaaagctttcatgcctccgggatattcgggcatttgttctacgacggaataaatgcgggtagaattcttgcgatacatgacgatggtatatggttcatccggatgttccagaaaagtattgatatccagcgatcgattttccataccttctacgcgtatcgttatgggatgattataatctgcatcgatgtgaaacagaccaatttcatcgctcagtacccggcgccctgttccctgaatgctgactacggctccttgtatgggcttcagtgatgagtctttgacatacccttcgatggcgaatgtcttgttactttgcttgaaggaagcaatatcgtctgcactatccagatagagcgttttgtttgtttccgtttcctttaacaagatagtagcgacagcgtttgtttcgtttccggggaagtaaatattggcaaaacgattgtatttttcgtctatttcgtaacggaatgtgattacaccttgatcgtttgacaaatacatgtcgtttctgccatttattttcagaatcattccgcgttgaggctccccgctggacttcaaaattgtgatacgaaattccgtacctttttcttgtccaaatatatattgaggaagaacaaatgcgaaacaaaataagaaaaggataaacgtatgcagtctttgagtagaattcataattcagctatctaaaataaaacggttgcaaagctacaagtattctgctgtatttcaaagtttatggaacaaataaatgcatgagtagcagggctaacttgttgttttatttgtaaatatgccggaatgtcgtatatttgtactttaatcacacctttatacttaataatttatgttaatcgatttacttcaatcatcttacttttctgttttcttgattgtagctttgggattcatgctgggacgcattaagatagcggggctgtcacttgatgtttcggccgttatttttatcgctttggcgtttgggcattggggcgtttccataccgaaggagctggggaactttggtctggttttgttcatttttacgattggtattcaggcgggacctggttttttccactctttccgtagtaagggaaagacgttgatactgattatattgctgattgttgcgtctgcttgtctgacaggcgtagctctgaaatatttgttcgatattgatacgccgagtctggtgggactgattgccggagcgctgactagtacaccgggacttgccgtggccatcgacagtacacagtcgccactggcatccatcgcttatggaatagcttatccgttcggcgttattggtgttattttgtttgtaaagcttttacccaaaatattgcatgttgatttggagcaggaggcacggcgtctggagaaggaacggcgtagccagttccccgaattgagtacttgtctgtttcgggttaccaatcctacggtcattggccgcactctgatgcagctcaatattcgtgtgatgacgggagctgtcatttctcgtttgaaacggggcgaggagattatcattccgaaagctcatacggtattggcggaaggcgattatgtacaggctgtgggaagcgaagattcgctgaataatctggcactgatgctgggtgtccgcgaggaaggagaattgccgctaagtcatacgcagagtatcgaatcgttgctgttgaccaaaaaggatatgataggcaagcagttgtgtgacctgaacttgcagcgtaacttcggatgtacggttactcgtgtgcgtcgaagcggaatagatatctcaccttctccagacttggaactgcgttttggcgataagctgatgattgtaggtgagaaggaaggcattcaggctgtagcacgtctgataggaaacgatgtgaagaaactttcagacacggattttttcccgatcgctatgggtattgtactgggtgtcttgtttggtaaactgaatatttcgtttggcgacggtatgtctttctctccgggactgacaggtggtattttaatgatggcgctgttcctgagtgcgataggtaagacgggacctattatctggtctatgtccggaccagccaatcagttgctccgtcagttgggactgctgctgttccttgcagaggttggtacttcggctggtaagacactggtctctacgtttcaggaaagtggattcttgctgtttggcgtgggagcagccataacattggttccgatgctgctggcagctctggtcggaagattgattttcaagattagtaccctcgatttgttgggtaccattacaggaggaatgaccagtactccggggctggctgctgccgattcgatgacggacagcaatattccgggagttgcttatgctactgtgtacccgattgcaatggtgttcctcatcctgtttatacagattattgccctgactattctttaaaagagcaatacagcctcaaacggaagttattctggtttgcaactatcgtttgaggctgtatgtcctgattatttctttttcccgaacgatcgatattcgagtggagtgaatcctgtatttttcttgaacaagttggaaaaatgttcggtggaagtatagcccaacataaaacaaatttcttttactggtgaggcggtatttatcagcatttgtttagctttacgaagcttaagttcctgaaaatatttggcaggtgaataaccggtatattctttaaacatttttcggaaccacgaatagctgatattcagtttagctgccagttcttccggatttatgtccttgcagacattttcgttcatgatgattttggcttgttccattttttcggctacattgtccttttcgaattctttgtttttcgagatagacagcaccatgccgacaatatgcagtaagatgcccgaaagatactgctgggaagcagtcttatcagcctctgatacttccagagcctgtgcaaaaagtgcagcaagaccttcgttgagacctatttccagtacctgctcttgtttagacagaaatccgttttttatcagctggtcgatgaagtttccttcgaaacctatataatattcgttccagccggtagctgtatcgggactataagtatgccattgtccgggaaacaatatgataagatttccttttccgataattcgttctggtgtatcgtcggatgcaaaggtccctttgcctttggtgatataaagtaattgatactcgtgcagtgttcgtcctttttgaacgttgaacaggtatcctgaaggatgttcctttatgggataaggagaatgaggatgtatagattgaaatcctacggtattgacccacaatccgaattttctgtctttttcattaacaatcagatatttgaactctgattctaaatcattgtatgatcgtgtcatcttcagtttttcataagtgtattattgatgaacaaaaatacaaattttgagttaaatatgtttggttgtcctatatctgttttaaattctttagaatacatggaaagtggaattattgaaaaagaccagaggaatagtctattcagattttcctctggtcttgatacgcatgacgaaattttaatgaactctgtcaatagcagcttcggtgtgtggacaaataaagttcgtatagcaatatcctgtttttatcccttctgttatatttctggtgcttatatgacaaagccgtttcttatttaggtaagtggaaagcaacagatatttctttcatttgttcttggctcatgccctcgggttcaaatcccatattcttggctgcaatataaattagagcagatttattcagaacatctacttggtcgaatgccgccatgatatctgtatctacggcaaatactccatgtttttcccacatgacgacatcgtagtcgcttagttcatcaatggtcgcctctgcaagttctacggaacttgggagtttgtaaggaaccattcctaagcctctcgggcagaatgcctttgtttccggtatcatactccatagcagattggaagcatagtctttttccataaacttcttgttgtgtgtcatggctatcagttcgatagggtgcgtatgcaaggaggctttgtaattcgagcctttggcaatgagatagttgtgtacactcaggtgtgaaggtagttctgacgttggatttaccggctggtcagcaatgattacataggttgcacagtcgtccaaaatacggatgacagaaccgtttgccatcggatcgcgggcaaggtcacgcatgcgcctgttggtccctttgcagaaaaagtaacaacctttcagatacggtaaggtggcacctattggctttacttcgctaatggcaggcatagcttttatcgtatcgtctacgagttctgtaatattgatggtgatatttcctccgttacgttctgcccatcccttttgccataaatatccggccacttcggccactttattgatttcggctgccagagccgggcggttattcaaaatcgattccatagttatatagcattaaatatatgataaagttattgctcaggcttgcgctattgcaactacgataatagatgcaatcagtactgcaaggccgagtaggaggatgccgatggtactggcactgcatcctttccattctttcagtaagattccccatacgttactgaaggtaacattcagcgacatgagtatactccatgaaaaggcgagtaatatcggactctccgtaaggaaacttttccccatttccagaccgaaaaactgtgaataccataagactcctgccagtgcgcaatatagtagattattggtaaatgtacttttatttactgataaatattcttttcccgtattgtttttcagattttgctgtatgcagtatgctgcatttgtgcaaaaaccgcctaacgtaaccaaaaagatgacgggtaggccggcgtacaagggggctgttcccttttcaagagctgcttcctttatcggagttccagcatccagtcccaaggcaaagcaagcactcatgactccggcaagcaaagctactaacaagcctttggtcagggcaaaatcttttacagctgctttcttctcttcttcactcatatttctggaacggaggctgcctgcatatccgatgacggcaatgcctgccagtgtgatgcatactccgatgagtaacatcaaacctgctccgtgcaataggtctgttcccccaaacaaggcaggaaacaatgttccgaaggccgcacatgtacctaatgaaatgctttgtcctaaagctactcccagatagcgcatactcagtccgaaagtcagacctcctacgccccataagataccatatatgatggctggcaaagcacctccgctgctccatagttccggaagcgtgctaccggaaggaactgccaataaggctcctaacaagggaaatacaagccatgcaaaaattccttgtacgagccagaaactttcccacgaccatttttttactttattgatgggtacatacgaactgctttgtccgaaacttcctatggctataattaacaaaccgatcagcgtgttcataaagagtatgattattttatccgatttttgtttgtattttccaaatatcatctacaggcatagccctttgagtgaaatctgcaatgaaaatttagttacgttttgaggtaacttctgcttcatatttttcgatgtcgggaatatattcctctcctacaggaacgttgttctttaagcagaacatatcccatacagcattccatggcagaactttggcttcttcaagcagagccagacgctcgaataactgattattggcttcgtattcacggagttttgccgttggctcgagcaatgcacgcaacattgatttctgggtagctcgtgctccgatgacgtaagcaccgatacggttgatactagcgtcgaagaaatccagaccaatatggacgcggtcaagtgcgttgcaacgaacaatttcctgacacaagtcgactgtttcatcgttcataatggtaacatggtcgctgtcccagcgtaccggacggcttacgtgcagcatgatttctggaacatatagtagcagagaggatagcttgtcggcaacgctttctgtaggatggaagtgtcccatgtcgagtgtaatcattttctgccggctgacgccgtagccgatataaaaatcgtttgaacctacagtataactttccagaccaataccgaacactttcgattcgatgcagtctttcatatttttatattcagtggcaaaaatacggtcgagtgagtctttcagcaattcacgatacagcatgcgattcacagtaatatctttgcttccgtcgtgaacccatatattcatgatacaagggtcgttctggcgttttcccatttcttcggctatggcccgacagcggacagtatgttcaacccaaaaatcgcgaattgctttatccggattggctaaagagagatttccacttttagggtgcgagaaagacgttgagttaaaatcaagtttcatcttgttttctgcagcccattgtatccaactctcaaagtacgatacatccacctggtctctgtcgacgaactttccttgaaaatctccgtatatttcatgaagattcagacgatgtgttcctggcaggtaggaggcggcttttagtacgtcctgacgtacttcgtcgatgttacgggctttcccaggatagtttcctgtagcctgaattcctccgctgagtgagccgttggattcaaatccggcaacgtcatctgcttgccagcagtgtaaggataatgatatcttttgtaaggtatccatggctttgtctacatctactcctatggctgcatagcgttctttagctatttcatacgcttgtctaattaaattttctttcatgatatgtatttaggttattgattgattattgagtaattgtttgaaactgaagataagccgcatcccatatttctttgtgctcgggatagaacgtctgtaagggggtgatacgacgtaataactggcgcatagaagcaatgttggttgcttggcctgctgctacagcctgtaccatgatatttcctatggcagtcgcttccgaaggaccggctacaaccggtatgccgattgcgtttgctgtccattggttgagtaaatcgttacggcttcctcctcctatgacatgcagtacttctatgggatggggagataaactttttagattttcaaggacttgtcggtaacgcagggctaaactctcgaatatacaacggactaattgtccgcgtgtttcaattgcaggctgattgtggttgatacagtatttcttgatagcttcttccatgtttgacggattggcaaagaccgtatcgtcgggatagattaaatttcggaacggttcactggcgtttgcttcagctatcagggtggagtatgaggtcccttcccagttgatgcgacacctttccagcagccacattccacagatattttttaataaacggattgtgccgtctactcctccttcattagtaaaatttagtttctcggtttctgatgttatgacaggagtctgagtttcaattcccattagtgaccaagtgccgctgcttagataagcaaaattatgattggctgccggtactgctgcaacggcagcagctgtatcgtgtcctgctacagcaacgacagggatagctcctagtttcgtttgaagttgaacttcttctgtcagatttcctattttctcgcctggatatacaaaacgcccgaagtgttgtttacttaatccaatgctttcgagtaatgatgattcaagactgcgcgtctgtgcattaactaactgtgctgtcgacgcaatggtatattccgtgaccatctctccggtcagcatgtagctaagtgcatctggaatgaagagtattttgtgggcgtttgctaaggcactgtcattgttcctgcgcaaagtatcgagttgaaacagggaattgaagttcatgacttgtataccggtacattcgtatactttacttctggatatacgctggaaatatttttctggtgctccagtagtgtgcgggtcacgatatgaatacggttgtcgtagtattccaccatctttcccgatacatacaaaatctactccccaggtatctatgcctatggaaattacttctaactcttttctccggccaactattttcaagccttctataatgtttcggtaaagttcatagatatcccaataaaaatgtttacctatttctatcaggtaattgggaaatcgattgatttcttctgtaaccagtccttgtggagtaaaatatcctacaatggtgcgtccgctggttgctcccaggtcgatagcaaaaaagcattttgtcatggtcttaatcagggctttatgtttttcaagtttagatgttgcaaatatagatctttagtgaaggataaaattgcgctttttgatttagcgactgactcttttgatttacttgattgaaagttctgtggcctttttattgcataaaaaaagaagaacgtttttatgcagataggctaagaaaatgaatagggaaaaatatcatttgtgaaggggtaggaattttggaatataatcgtacgttatttatatttgtatagtaataatatggtgtatattttaattgaagcaaaatgaaatacttgacaaaactggctggaggcatcttgttgtattttgccgcagcatcgacgatgaatgcgcagttgccatgggaaaacggtaaactggaagtgtctgccgaagggcgttacttgaagcatcagaacgggcaaccatttttctggctgggagatactggctggctgatgccgcaaaggctgaaccgggaagaggtggctttttatttggataactgtagtcgtgccggattcaatgtggtgcaggtacagacactgaatggggtgccttctatgaatgtatacggacagtactccatgacggatggattcgacttcagtcatattgacaaggagggagtgtatggttactggaatcatatggattacatcgtccgtacggccgaaagtaaaggtatatatataggtatggtatgtatctggggtggactggtaaggagtggtcagatgaatgtggaagaagctaaagcttacgggactttcctagccgaaaggtataaagacagtccgaacattgtgtggataatcggaggagatacacgcggagatgtgaagacggaagtctgggaaacgctggcacgtaccattcgttccattgacaagaaccatttgatgacgtttcatccgtttggcagaacgatgtctgccacctggtttaatgacgccgactggctcgattttaacatgtttcagagcgggcatcgccggtacggacagacgaaaggagatggtgacaatcttgccgacagtaatgtggcggaagataactggcgttatgtggaagccagtctgtcccaacgaccgatgaagccggtcttggatggcgagcccagttacgaaggaatacctcagggccttcacaatcccaaggaatatcgttggacggctgccgatgcccgacgttatgcttattggtcggtctttgccggttctttcgggcatacttatggcaacaattccattatgcagttctatcgtgaaggttatactcctgcgtatggagccgaaaagtcatggcaggaagcgttggaggatgaaggattcaatcagatgaagtacttgaaggaactgatacttcgattcccttattttgaacgtattcccgatcagagcgtaattgcgggggtaaatggagaacggtatgaccgggctatcgcgacacgaggccgggatttcctgttggtttataactatagtgcacgtcccatgcagatagatttgacgaaaatcagtggagataaaaagaaagcatggtggttcaatcctcaggatgggagtatgaaatatataggtgagtttgaaaataaggttacggactttcaatacgatgctccttacatgcgaggctacgaccgggtgctggtagtggttgatgcagcgaaagattacgtgacggattaatctatactaaaaagctctgtcactcttcaataaggggagtgtgacagagcttcttttaattccctttatacaaattgttatttagggaatattctttgtttgttatgtccttaggttattgggcctattttttaccggcgataactctccagacgatggcactcaatatggctccgatgaaaggacctacaatgaaaatccaaagttgactgagtgctactcctccctcgaataaggctggaccaatactacgtgccggattaacggaagtacctgtgtaacggatacaagccagatgtactagtatcagagaaagtccgatagccaatccggcaaacttcccggcccctttttctggatcggttgtgcccaatacgactaaaacgaatacaaatgtaaatacaatttcagctagtaggccacctaagaccgaaattccttcctgacagctgttagctcccgtacctgtgagtcccgaattgcttgtcagcaaccagaggatagccgatcccaggattgctccaattacctgaaagataatatacattgttgcatcttttgcattgatgcgtcccgataaggcacagcctaatgtaatggctggattaatgtggcatccggaaatttcgccgatagtataggccatagccaccactgctagtccgaaagcaattgctgtaccaataactgttgctgctaaacttgggtctgccgatgtgcacgataaactgactgccgtgccgcaacccatgagaaccagaaccattgttcccatcatttccgcaatgtactttttcataactatatattttaaagattagaggataacttaggatgtgtttgtgagaactaattcagcacaaggcaagttattaaaaatctttcaaatacgcaagtttcaaagcgaaaagatgttcctcttcgtctaaagaggggctatgttggtcaggtcatttcctgatggacgctggaatatgcgcaggccgaactctgggataacggcaagaatatagtcgaaaatttcaccttgtatctgttcgtattcgggccagacggttgtattcgtgaagcaatagatttccaaaggcaatccttcggcggttggttgcatctgacgaaccataatcatcagctccttgtgggtacggggatgattttttaaataattcagcaggtagttgcgaaaaacatgcagatttacgacttgtgtttccggcttactttgttcttcgtctatccatccgcgtgaggcaaactgttgcttctctttttctgagcagaaatgtacggttgtcatgtcgatgaataccgagcgcttgatacgtcgtcctccggtttcacgcattcctctccagttctggaatgagtcgctgactagtacgtaggggggaatggttgtgatggttttgtcgaagttgcgtaccttgacggttgttagcgaaacttccagcacatcgccgtctgccccgtacttaggcatcgtgatccagtcgcccggacgaagcatgtcgtttgccgaaagttgtacacctgccaccagacctaatatgctatccttgaaaatcaacatcagtacagctgccgaagctcctagtccggcgagaatggttgccgcattctggtcaatgagtatactgataatcaggataattccaataccaatagctattaagttaatcatttggtagattccttttagcggccggttacggaatgtctcatgctcgttggatatttcatatagtgaattcaggaatgagttgatcagtaaaagggtcgtaattaccaggtaaatcaggcatgctttcaacaagatattaagaagttgaggtacattgctgaatacaaaaggtagaagcagataaaacatgataggagggatcatgcggcaaaaactattcatcattcttttgttgaataggtaatcgtcccatgtcgcttttgtgcgggaggttatcttgtgtacggctggtataaccagatgtctgaataattttgtgatgatgtaggaaatgagtaatatgagaacaacaagtgtgagacgggtactccagctcaggttctctttatcgatgcccatatctgataattgctgggctacttcgagatataaatcttccataaatatttgtatttgtatgtcgttttggcaaatatacgaagcttttttcatatatttagcgggtatatttaaagattaagagaatgttacgtctttatagtctgctaatgttgctgctttggggtatgctgtgcttaccgtcgtgtgttcgagaagattctccttctggggaggaagggatttgcccgggagatcggttacctgattgcacttttgttttgagtgacaatactcgtgtgtcgacttccgatctgcgaggaaaagtttctgtactggtcttttttcatacttcctgccccgactgtcaacaggagcttcctgttgtacaagaactttatgattattatcgggatgatgcttcggtaagggtatattgcattagcagggaagaaaattccgctgaaattgctgcgtattggcgggaaaatggattgacaatgccttattctcctcagtcggggagggagatatattctttattttctgaacgggggattccccgtgtttatattgctgataagcagcttgtagtatattcggtttattctgataatccgagtgcttcatttgaacaattgcaggcggatgtagaagcttctttgaaatgaagttgaatgaggttgcacgaacggaggtggaatgtgcatttttttctcatatctttttgcaaaacaaatggtttcattaaatttgccgtcaattaaactactaatactaattaatatattatctaatgagcttgaaaattgttgtattggcgaagcaagtacctgacactcgctgtgtagggaaagatgccatgaatgccgacggtactatcaatcgtgcggctcttccggctatcttcaatccggaagacctgaatgctttggaacaagcgctcagactgaaagacacacatccggggtcaaccgtaactatcttgaccatgggaccgggacgtgccgctgaaatcattcgtgaagggttatacagaggagctgataatggttatctgttgacagaccgtgcttttgccggagctgatacgttggctacttcgtatgcactggctacagctatccgtaagattggcgagtatgatattatcgtaggtggtcgccaggctatcgatggtgatactgcacaggtaggtcctcaggtcgcagaaaagctgggattgcctcaggttacatatgttgaagaaattcaggaagtaaaagacggacgtatccgtgtaaaacgtcatattgacggtggtgtagaaacagtagaagctccgcttccgattgtcttgactgtaaacggtagtgctgctccttgccgtccgcgtaatgcaaaactggttcagaaatacaaacgtgctttgggagcacaggaaaaagctgccattacaaaagatggaacagcattgccttatgcttctttatatgagagccgtccttatctgaatatcacagagtggagcgtagccgatgtaaacggtgatacgaaacaatgtggtttgtcgggttcacctactaaagtaaagaagattgaaaacatcatcttccaggcaaaggaaagcaaaactattacaggtagcgatgctgatgtagagaatttgattgtagaactgttggctaaccacactattggataaagactatgaataacgtatttgtatattgtgagatggaaggcaagcatgttgccgatgtcagtctcgaacttttaaccaaaggtcgtaagttagccaatcagttgggatgtcagttggaaaccatctgtgccggcagcgaccttgccgatgtagaaaaacaagttttgccatacggagtagaccgtgttcacgtgttcgatgctccaggcttgttctcttatacttcacttcctcatacttctattcttgttaatttgtttaaggaagaaaaaccgcagatttgtttgatgggtgctaccgttatcggtcgtgacttgggaccgcgtgtatcttcagctttgacaagtggtctgactgccgactgtactcagttggaaatcggtaatcacgaggataagaagaatggcgttacttacgaaaatctgttgtatcagattcgtcctgctttcggcggtaacattgtagctaccattgtcaatccggaacatcgtccgcagatggcgacggttcgtgagggtgtgatgaagaaagaaattgtagatgccaactatcagggtgaagtgattcgtcacgacgttgcgaagtatgttcccgaaacggattatgtagtaaaggttatcgaccgtcatgtagaaaaagcaaaacataatctgaagggtgctcctatcgtagtagccggcggttatggtatgggaagcaaggaaggattcgatatgttgttcgaacttgccaaggaacttcatgcagaagtgggtgccagccgtgctgccgtggatgccggtttctgcgaacacgaccgtcagatcggacagacaggtgtaacagtacatccgaagttgtatatcgcttgtggtatttctggtcagattcagcatattgccggtatgcaggatgcaggtatcattatatctgtaaacaatgatccgaatgcgccgattaataccatcgctgattatgtaatcaacggaacagtggaagaagtgattccgaaaatgattaaatactataagaagaacagtaagtaaagagattatggcaaacttttatacagaacatccggaactcaagtttcacttgaacaatccgatgatggagcgtatctgtcagttgaaagaacgcgattacagagataaagacgagtacgattatgcaccgcaggattatacggatgctatcgactcttacgataaagtattggaaattactggtgaaattaccggtgaggtgattgcagccaatgcggagggagtagaccaggaaggtccgcaccatgctaatggacgtgtggaatatgcttcgggcacaaaagctaacctggatgcaatggtgaaggcgggtctgaacggtatgacaatgcctcgccgttttggtggtttgaacttcccgattactccgtataccatgtgcgcagaaatcgtagctcaggctgatgcaggtttcggtaatatctggtcattgcaggattgtatcgaaacactttatgaatttggaaacgaagaccagcacagtcgtttcattccacgtatttgtgcaggtgaaactatgtctatggacctgactgaaccggatgccggttctgaccttcagagtgtgatgttgaaagctacttacgatgaggctaacaactgctggcgcctgaatggtgtgaaacgttttatcacaaacggtgatgcgaacctgcatctggtattggctcgttcggaagaaggtacacacgacggccgtggattgtctatgtttatctacgataagaatgacggtggagtagatgtacgtcgtatcgaaaataagctgggtattcatggttctccaacttgtgaactggtttacaagaatgcaaaggctgagctttgcggcgaccgcaagcttggtttgattaaatatgtcatggctttgatgaacggtgcccgtctgggtatcgctgctcagtcagtaggtttgagtcaggctgcatacgatgaggctttggcttatgcaaaagaccgtaagcagttcggtaaagccattatcgagttcccggctgtatacgacatgctggctactatcaaggccaaactggatgctggtcgtgcgttattgtatcagacttctcgttacgtagatatctataaggctttggatgatattgcccgtgagcgtaagctgactccggaagaacgtcaggaacagaaacgttatgcaaaactggccgatagctttactccgctggcaaaaggtatgaactctgaatatgccaaccagaatgcatacgactgtattcaggtacatggcggttctggattcatgatggaatatgcttgccagcgtatctaccgtgatgctcgtattacaagtatttacgaaggtactactcagttgcagactgttgcagctatccgttatgtaaccaacggtgcttatgctgctaccttgcatgaatacgaaacgattccttgcgctccggaatatgaagattatatgaaccgtatcaaggaaatgactcgtaagctggaggcttgtacgaatgcagtaaaagaagctcaaaaccaggaattgctcgatttcgtagcacgtcgcttgtatgaaatggcggctgtctgcgtaatgagtcatctgttgctgcaggatgcaacgaaagctcctgaactgtttggcaagtcgttgaatgtatatgtaaattatgcagaatcggaagttgagaaacatttcaactttatccgtaagttcaatgcagaagaactggcaaattatcggaaataaagtattttctgattttgcttataatctataaatcagtataaacaatcctcctgtttttagccttggttcatttatatggctatatacaggaggattgtttttttgtatatcaacgtaaggtgatgcataattgcttgacttgttcttcaaattcatcccgattacgcgcacggttacgtacagatgtccgatagttataaatggtttgtggggaataaaacatgagggtggctatacgggaactgtctttaattcccatgcggataagggcaaagattcgtagctctgtgttaagaatttctcccttttgtggataaatttcttctccgggacgtaacagatcattgaactctgttatgaactgaggataaagggtcagaaatgcagtatcaaaatttacgaaaaaacgtttggtatctgcttccgacatttttgtattgttttgttttaataaatcatcggcctgttttgccttgatttttcgttttaccaaatcttggtagcggttaagtttgtcgatataggaggcacataaatcgagaaacagactgacatattcttcccgtgtatggttcgttttgaaaagttcatcgttgagatggcagagttgttcattcaattccttaagagaatgctgtgctttatttacctgtcgtaactgacggcgtataaagacgatggatgcaatcagcaacagacttaaagcactgatgaaaattacagctgctgtgaggtgatgtttcgcatcaatgttttcctgttggtatgcattgaagatagcagggattttacgagctatttcaagcattcgaaggcggttgttgtagaaagttgcgtcttccatggaatattgcaggtatcggttggcctgctccattgattgtgtcttttgtcgataaatgtataaagccaactcctgtagcgacaagttttcttttagtgggcagacattgtcggatatggcggaaagaatcagatagcgttcaagctcttgcagatgtccttgtctgctatgagcaaaagccagtccgcacgtaatgcatgcataaagtcgagtatttacaggtatacctttcaatgccttttcataagctttttgtgcaccttcctgatcaccggtccgtgctttgtattctccggcccagtaataatattcattgctcccgggagggagtacttgtagtaaagagtcgttgtaaagaatctcttttttccggtagtgtggggcatagtattcatcatcggtatattcactccatacactatatacccattcgtaggcttcataatagtctgcaagtaatgtactatctatgcttgctctgtcaatatgttgtaactgagataaagcctgagaaaaatatccggttgtggccagtacggtcgcccggctgatatagcaaagatgtttctgcttgagaatattggttcgtgaagctatttcttccgccttgtcaatataaaagaaggcagaatcagatctgtacgtaagatattcctgatagagggtatagtaatggtcgaaaagcttttgagccgacatatccagcgttattaaattttggatactgtcaattcgagcttctttacgttgggaagctatattgcgttgagccagggaaagttcaagttgtctgtaaagatctttaatatcttgttgtgcatggataacttgaagtggaatgataaacaaaaacagagaaagtagattcttcatataatacttggcttaagattcttccttgtagctttatcaaaagcgaaaataaggattttttgttgaatatccaattttagagattatctattttgagaaaaaagtaaaagtttatatctactttgatttttaaatgcaacttataaaagtattgattatcatatgtatatagatttataatgttgtgcttcatctactttagctctactgctagaaacaaagggaatcacctcatattacttttgcggcacgaagaatttctttacagaatgttcctcgttgaaagagtgattattaacctttggaatgtataatccttaaattgtagatttatgagaacaaaaatgttattcccttgcacaatgattgcggtctggacatcgggtctgctttctgttgcttctgcacaaacagtaacagatagtgtgaatgtgaagaaggcagatggtagtgaacgtaatgtcatgctgaatgcttcagatgcgacaaagcctcgtgaaattcaaattggtttacctagtgaagatgtaaacgtatatgagaatggtcttcctgccgtatattcgtctgctgtacataaattgcaatatcattggcgtagtgatgccagtttaggagaagttggtttgatgtcaccttcagagtcggctattcgtacaggtaatatcgcttattcggtcgattcctatagtaagttgggtcagaaagaatttaaaggaatattgaattaccgcgccaatcatttcggtatgcagcagttcgatttaaacgtttcaggtggtatcggtgataaatggttgtattctggcagcgtatatcagaatttcgatcccggaagttttgaggcaaaatttgatgaatataccgaccgtatgcaaatgtatcgtgctggcataacacgtttgttgggtaataaaggtaagatcagtttgcaatataaatatgcttatagccgaaatacaggaaatgaactgaatgctgcaccttttatttacgtaggtgatggttccatcaaggaaattccaggatttgaacccggtctggcttcttatggtccggcaagtggtgaaatagagtatatggatgtcatggatggaaagatgaaaaaggctaatttgcgtgacttagagaataaccgttcgcacgaaattgcgttgttaactgattatacttttgacaatggtgcgaaatggagtttgaatatgaagtatatgaatgctccggaagccaattatgtcgattttggtggtagtactattagtgagctgagtgtggaagatggttatacgctggctgatggcacaccttattcaggtcttgtggaaggcagacgtacttggctgcactttggaaaagttcagaatttcctgattacttcagaacttgagaaacgttttggcaatcaccagttgcgctttggattgaatgaatggtattattatttggattatcattcatcttctttccagtgggtggggagcgtaaaagagtatcctgatattctgacagcttcagatggttcacgcttctatggctttaatgaactgagtccggaatacacggtaggatcggaaaataaattggcggtatatgtaaccgataactggcaaatttctccaaaattgaacttctattatggtgggcgactggaatattatcgtatgtcggccgaccaggttgcccattcacgctactcaggattctatatcggtggtacagctcctgacggtgaagtgattactcctgctaatgttacaaaggataaactgaattatgctgcaactgctcagttgacttataatatgactaaacattttggcttgacggctgatgcgactgtggcaactcgtttcccgagaatcaatgaatatgcaggaacaggtcctacagaagagcagtataaacgtgtgactattcctttgatccgtggcgggttattctataagaatagctggattgatttgacttccatggtaacttatatcgcaaagaccaataacatcgatcagcagaatctgactaaacctggtacgagtgaaggcaagaccgttttgctgatttatgatatccagacactgggatggacgacttctgctgaaattgacccgttcaagggattccatctgcacgcattgtttacttatcagaagcctgtgtacaaaaattatagtgcaggcgtgactttcaatgatggaacacagatgagtgtcaatgccaacaatatgattgtgaaggaaattcctcagattcttgtagagttggatccaagttacaacattacaaaagatttacgcttgtggttgagcttccgttatttcggtaaaacctatgccaatttgcaggaagcactttactttaacggacgctgggaaacatttggtggaatcaactggagtgtaaacaagcatctggatctgggagtatctgtagtgaacttcctgaatcagaaaggtgcgaagggtaccatcagcggttctgaactgattacgaaggaagaagcttcaaaatatgctggttgctacatgagcggaagctatttgcgtccatttacagttgaattcagcgcaagtattaagttctaaaaatataaactgaaaatctttagataaccatgaaacaattattagtatcaggagcattattactggctgccatgcaggtaaatgctgtcgaaaagaaagtgtttcgtatttctacggagcagaccgatctgattcttcaggtaggagataacggacgtctatatcagacttatctgggtgagaaacttttaaatgatgctgatatccagaatttcgcatggaatgtacatgcaggttccgatggaagtatcagtcagcgtggatgggaagtatatagtggctcaggaaatgaagattattttgaaccggctattgcgataactcataatgatggacataattctacttatctatattatgtatcatctgctacacaaccagtagagggtggtgtacatactaccattaatctgcgtgatgaccagtatccggtagatgttactttacattatattgcttatcagaaagagaatgtaatcaagacatggagtgaaatcaagcatcaggaaaagcgtccggtaacgctgaatacgtatgcttctaccatgttgtatttcaattgtccttcttattatctgacagaatttagcagtgactgggcaaaagaagcacagatgagcagtcagcaattacagtttggaaagaaagtgattgataccaagttgggtagccgtgcagcaatgcatacgcatccgttctttgaagttggattgggacagccggttgccgaaaatcagggtgaggtactgatgggtacattgggatggactggtaacttccgctttacgtttgaagtggacaatgccggaaatcttcgtgttattcctgctatcaatccttatgcttcttattatgaattgaaaaaagacgaagtgtttactactcctgagttcatttttacattaagctataatggtacgtctgaaggtagccgcaatttgcacaactgggcccgtaattatagtttgaaggatggaaagaaagaccgacttacattgttgaacaactgggaaaataccggatttgattttaatcaggaaaagctggcagaactgatgaaagaggctaagcacttaggtgtggacatgttcttgctggacgacggttggttcgccaataaatatcctcgtaaagatgataaggcaggattgggcgactgggaagtaactcatagcaagttgcctggtggcgtacctgcactggtagaggctgcaaaggaagctggtgtaaaatttggtatttggattgagccggaaatggtaaatccgaagagtgaattgtttgaaaaacatcccgactgggcaatccacgatacaaagagaaaattgtattattaccgcaatcagctggtattggatttaagtaatccggaagtacaggactatgtatacggagtggttgacaaattgatgaaggaaaatccgaaaatagcattctttaaatgggattgcaacagtccgattacaaatatttattctccgtatctgaaggaaaagcagggcaatctgtatatcgatcatgtacgcggcgtgtataatgtcatgaaacgggtaaaagaaaattatccggatgtaccgatgatgctttgctcaggaggtggtgctcgctgtgattatgaagcactgaaatactttacagaattctggtgtagtgataatacagatccggtagaacgtgcttacattcagtggggattctctcaattcttcccggcaaaggccatgtgtgctcatgtgacaagctggaacaagaatacttctgtgaaattccgtacggatatggcttctatgtgtaagctgggatttgatataggcctgaaggatatgacgaaggatgagctgtcttattgtcaggaagctgtagccaactggaagcgtttgcagccagcagtaatggatggtgatcagtatcgtctggtttcaccgtatgttaccaatcacatggctgtaaattatgtaagcaaggatacaaataaagccgtactgtttgcttatgatatctatcctcgctatcaggaaaaactgatggctgtaaagttacagggactggatgcccataaaatgtataaagtagaggaaatcaacctgatgcctggagtaacttctacattggaagcaaatggaaaggtgttctcgggtgattatctgatgaaggttggtctgaatgtctttggctttgccgcaactcagagtcatgtgatagaactgactgcacaataaaatgtgatattattaaacttataaatatgcttatttcaataggcaagattaatttttaggatagaggttgtactccctttgttcggcttaaggcttgagcaaagggagtttttatgttagtctttatagataatgtaaacttgagtctgattacaataaatgcttgtacttacgtcttaaccagcggtcgaaaattcgcaatagaggcaaggctatcagcatgggaagatagaatatgagcgatgaaggttcgggcaagctatgggtcattatatacaatgcttcggctatttcttttccgtatgcccatacgaccatgccgatgcatcctgtgaacatgcaagcaactgtgatgatcattaatatgaacatacgtttttcttgtcgtttctcacgcagatacatttcttcagcaatccgtttcatggtgcgataggtgaaattgctggaaagccgtggagtatgattttgtctggcagcttttcttaatccattgtccttgttgtctgtcatagttaatcctccttttgcatcagtagatataattttttgcgtaagcgatgtagtttgactttaatattcccttcgttcaggttcaggatgtgggcaagttcctgtataggacgttcctcttcataaaatagagtgaccagcgcacgttcttcggccgtcagtttggtcaatgcttgttgtagcttttctatttgttcttctgagtcattattcaaagcatcatctatttgtgtatccgatatctggttccaagagttttcgtcaatcacagtttgttctacatttttctttctcagaaaagagagtgccgtattataggcaatacggtaaatccaagtagagaaactacttttcccgttgaaggctgataaatgttcgaaggctttcataaatgcatcttgcgtcagctcttcggcatcttcttcggaattgaccatacggacaatcaaagcaaaaaccggttgtccgtaggtatcgaggaagtaagcatactcttcagtctttcctgccaggatacgcgtgatgatatatgattcgtcttttttcatttgtctttttagacgcttgtcagaagtcgaggttacaaaaatacggaaaaaattttttcttcattagaattgtaaccttttcatgtattggttcgtctaaacggacaaagaaacaaaattattcacttaaaagaaatgcgatatggaagaattaatgattgtggctaatgttgcaatagtttttggagttatttacaagttgttcgaactgtttgtcggtaggaaagaacgtatgatgttgatagaaaaacttcctgtggaaactttgacggacgaaaagctgaaaaatggtggcttgtctttgtgtgatttgaaggagaatctttttccaacatcttctacctctcttcgttttggctgtctgctgatagggcttggactggggctattggctggctattgtctcgttttaaactcacagccggaatattttgcgagcgatgaaatcagtcgtcctgtccgtgaaaccgtttccattatttatggtgcctgtgtgttgttgggaggaggtattggactgattgtagcatttgttatcgaggtcattcgtgcttcccgtcataaatagaagtccatattctgagcttttataaactctttgtatctttgtcggtgtaattgattggatttatggcaaggaaagaggaatataaacagcagaacattgatttcttgaaagaaatttcacagaaagaaggagtacaaagacatccttccggtattatgtatgaggttgttcagcagggaagtggtacacaatcgcctaatttgagaagtattgtttctgtgcattatcgaggaacgctgatcaatgggcgtgaatttgataactcgtggaagagaggatgtccagaagcattgcgcttgtcggatgtgatagaaggctggcagatagctttgcagcagatgcgtgtcggcgatcgttgggtgatttatattccttctgaactggggtatggtaatcggccttcaggccccattccggcttgttccacattgatttttgacgtggaattgctcaatgtattttgaaaacttgtttaaaactcaattttattcaagatgaatgttaatctgaatcttgaatagtacggaggtaaaagagaagggtgtatcattactcaaaatagagtttgatatgccttttcttttgcactaattataagaattaagtagaggactattgttcgttgggcgcgtggagacagatgattgcagttacactccatgtaataatgttttagtctgtttcatttttcatcgaatcgatctttaaagaaaaaaccgtgaatgcttgtatcttattccttttatgtttaaattgcacaaaaggaataagatgtaagtcgttgattaaaatttaatatctatgaaaacgttttctcaaatttatttgtgttaagtgttgcttcgtgcgtgtttttttgtaactccaaagattcactgtggcatggggctgcatcatcgactgattttaatctctaagatgatgtaatgttgattgatcctaggctctactgagttgacttctgaagatactaacgagtatcagatttatttataaaacgtgagaatatttctcctactttttgctctgttccttcttcccgaaattagagggggatatcgtcaataaggattgataaggaatatattgcagcttgtgatgtggtaattttgatcgttttatagtagaataaaagtaatgcgataactttaataaatcaatttagaatatatgagaatcgtagaaaatgtagttgcagcattgttggtatttggttttgcggtcggactatctgcctgcaaagatgatggctatcctgaaggtccgctacctggtacagaatatgatatacttcctgtggttattaaggtttatgtaaccgatagcgaaggacatgatttgttgaatccggaagtgacgaacacgattgtgaacaataagattaaggtcctttacaaagctaaggaatatgagatgcattgggaaccggagcattcttctggatcaagggcaataccggttgtgtggaatgggttgcaggtgtgtaaaccttacaatgaagatggacgttattttctgacattcggtgatttcgatcgacagacatgttatgaagatgaagagtttgtgataaactggggtgatggaagttggaatacagtctttcgtttttccaattctttttggtgggaaaatcatgaacctgaaaatgtcttctatctttatgtaaatggtgagaagcagaaagagggatgggaagaggtcacaatagtgaagtcatttgataatgatatttagatggctaaccggtccttttagtgtgtacgatatgtacgagatgtgagtttattgcctttttagcccttcacaccgatttgtctcttgtcgcatatgactaaaaatgacgactctctatgcactggtgaagggcgtgaagggcaaaaacaggtgttttttttctttaaaaggtacctgaaatggtggaactagccctttacggtcttgttgaggtatgcttgttttcttctttgctcggatttttttgtcgtttccacagggaaggagtttttgcttttcttgttggagcaggattggaagtccaggaaagctgcttgtttattgtagtcgtagaatttttagaatacacacttttcgttgcttttccagaatgtatttgctgggatagtttggaatccgttactgcatcctggcttgttttgattttatcatccatacattttttgcatagtggggggtgaacttgaaaaatttgtttcttcgcctatctgttctgcagagtatatccggtatttttccccgtttctttcttctgcattgtacctgaatctttccttttccgcataatatttcatcatttttctgttccgaaccgcactattacgcggtgtctcggaaaaatttctttcgtatttccttcggtttctcccgctgttgtttcatgtttttgtacaaaactttcaggaatttgtacaaaacaaaatattttttgtacaaaaaccggagaaaattccggcatgttttttcagcattttcgggatctttttatgcggattgcggatttttttgcttttttctcttgacttttccggtggaaaaatccgttttttttttaatccgaccgtccgtcaatgacagaatttattcctatcggccgtatatctttcatgcttttttcggatgattcgataaatttttctgcttcttttcccgtgcatttctgtatttttccttccgcctacgaaaaatctgctgctttttccatccggatcatccgttttctgagattttttcgcttcgtcggaataatttttcttgccttttcccgagcggaactgagaaatttttcatctcattcccgtattttttatgcttctcctgaattttttcaaaagaaaaatccgcttttttcggttcccattacccagtttcggacatgtttttcctcgtcatcgggataattttcatgtttttccccgtgcagggaaagaaatttttctccccgttttcatcattttcgcactttttccggggcttttcaaaggaaaaatcctcattttccggaatgaattttccgtccgaacgaatattttttcccttcctcggggagtatttccggattttttttcgtgtcatccgataaagaagaccatccttccagaatatttttcgtcccatccggcaggaattttcacctttccggatttttttgcacggttcagacgcgcgcgcacctgcacgcgcgtaatagtatattgagtacccctcccggctccctttcccttattccggaaaacctgccgtaaaacatacctgaaacacagcattttatgaattttcttgcaaaaaaaattgaaaaaaagtgtgggtaaaagttggagaaagcgaaaaagtgcgtaattttgcacccgctttcgagagggaaagacgttgaagagatgacaatctgaaaggaaacggagcaggaagcagcggttctgcggcggtccaagtatcttaccttaacggcgttaagggagcgagaacggcagccggacggagtcaacttccgccgctaaaaaaaactttttgaaaaaactttcgaaaaagtttggcggtttcgaaaaaagctcctaactttgcaaacgctttcgacaacgaacggaagccgcaaaaaaggaaatagttctttgaaagactttagataaacaaacaaagatgtagtacaagaagtagctgtcatatataataatgtatatgcggtgaaaaagaaagaaccgtcaatatttgaacaaagtaaagacattcggttacctgaacagagacaaaagtactcgcaagagtaaaaagatattttacaatgaagagtttgatcctggctcaggatgaacgctagctacaggcttaacacatgcaagtcgaggggcagcatgaacttagcttgctaagtttgatggcgaccggcgcacgggtgagtaacacgtatccaacctcccgcttactcaggaatagcctttcgaaagaaagattaatgcctgatggtatcttaagcacacatgtaattaagattaaagatttatcggtaagcgatggggatgcgttccattaggtagtaggcggggtaacggcccacctagccgacgatggataggggttctgagaggaaggtcccccacattggaactgagacacggtccaaactcctacgggaggcagcagtgaggaatattggtcaatgggcgcgagcctgaaccagccaagtagcgtgaaggatgaaggtcctatggattgtaaacttcttttatacgggaataaagtggtccacgtgtgggcctttgcatgtaccgtatgaataagcatcggctaactccgtgccagcagccgcggtaatacggaggatgcgagcgttatccggatttattgggtttaaagggagcgcagacgggggattaagtcagttgtgaaagtttgcggctcaaccgtaaaattgcagttgatactggttcccttgagtgcagttgaggcaggcggaattcgtggtgtagcggtgaaatgcatagatatcacgaagaaccccgattgcgaaggcagcctgctaagctgtaactgacgttgaggctcgaaagtgtgggtatcaaacaggattagataccctggtagtccacacggtaaacgatggatactcgctgttggcgatatactgtcagcggccaagcgaaagcattaagtatcccacctggggagtacgccggcaacggtgaaactcaaaggaattgacgggggcccgcacaagcggaggaacatgtggtttaattcgatgatacgcgaggaaccttacccgggcttaaattgcagacgaattacttggaaacaggtaagccgcaaggcgtctgtgaaggtgctgcatggttgtcgtcagctcgtgccgtgaggtgtcggcttaagtgccataacgagcgcaaccctcgtggccagttactagcaggtaacgctgaggactctggccagactgccatcgtaagatgcgaggaaggtggggatgacgtcaaatcagcacggcccttacgtccggggctacacacgtgttacaatgggaggtacagaaggcagctacccggcgacgggatgccaatctccaaagcctctctcagttcggactggagtctgcaacccgactccacgaagctggattcgctagtaatcgcgcatcagccacggcgcggtgaatacgttcccgggccttgtacacaccgcccgtcaagccatgaaagccgggagtacctgaagtgcgtaaccgcaaggagcgccctagggtaaaaccggtaattggggctaagtcgtaacaaggtagccgtaccggaaggtgcggctggaacacctcctttctggagcgtgaccgagtgaaggtcctttctatcttgtgctgcatgcgagtttgtttaacgaaataaagagagaaagatgaagccgagtcaggaaacagacgaggttgaactgaatcacgcaagctagtcctatagctcagttggttagagcgctacactgataatgtagaggtcggcagttcaactctgcctgggactacctcgagaaaagggagcgaagaaaaaacttccttaaaaatttgctcaagcgaaagtaaatgcttacctttgcagccgcaaaaaaacgggggattagctcagctggctagagcacctgctttgcacgcagggggtcaacggttcgaatccgttattctccactatagaaaaataggtctatgacatgatgtaacaagcaaaaagtaattttagtacgaaagctaaaagtatatatcatcccgcattgttgaaaaatggtgtgaacgataaggaaagtaaagaagggcgcatggcggatgccttggctctcggaggcgatgaaggacgtgataagctgcgataagtcacggggaggtgcaaataacccctgatccgtgaatctccgaatgggacaacccaataccttgaagaggtattaccttacacagtaaggggctaacgcagggaactgaaacatcttagtacctgcaggaaaagaaaataacaatgattccccccagtagtggcgagcgaacggggaagagcctaaaccaccggtgttacggcacaggtggggttgtaggaccgcgtcgttgcaagaaatcttgcgagaagaacgatctggaaagttcggccgaagacggtgacagcccggtattcgaagcaagacgaagcatagcggtatcctgagtagcgcggaacacgaggaattctgcgtgaatctgccgggaccatccggcaaggctaaatactcccgagagaccgatagtggaccagtaccgtgagggaaaggtgaaaagcacttcgaacagaagagtgaaatagtacctgaaaccgtgcgcctacaagcggtcggagctcctaacggagtgacggcgtgccttttgcataatgaacctacgagttgccgtcgttggcaaggttaagggacacgagtcccgcagccgaagcgaaagcgagtctgaacagggcgtcgagtcagcggcggcagacgcgaaaccaagtgatctacccttggccaggatgaagtctgggtaacaccagatggaggtccgcaccaataagcgttgaaaagcttctggatgagctgagggtaggggtgaaaggctaatcaaacttggagatagctcgtactccccgaaatgcatttaggtgcagcctcgtggattactgatgtgaggtagagcgactgattggatgcgagggcttcaccgcctatcaagtcctgacaaactccgaatgcgcatcagttttaccccgggagtgagggcatgggtgctaaggtccgtgcccgagaggagaagaatccggaccaccggctaaggtcccgaaatgacagctaagttaaactaacgaagtctgattgctaagacagctaggatgttggcttggaagcagccattcatttaaagagtgcgtaacagctcactagtcgaggaatcgggcatggataataatcgggtataagttgtctaccgaagccgtggaaccagcaatggttggtaggggagcattccattcggcgtcgaaggcgtaccgcgaggtactctggagcgtatggaaaagcaaatgtaggtataagtaacgataaagggggtgagaaaccccctcgccgaaagactaaggtttcctgatcaacgctaatcggatcagggtcagtcgggtcctaaggctcagccgaacggcgaggccgatggcagaaacggttaatattccgttactaccttggagggtgacgtggagaagcagaagtgacactgccgcgggctgacggaatagcccgttaaagagtgtaggtgctgattcccgcaggcaaatccgcgggaagagccgaacttgacagtatggagcgtcctccgggacaatccaacagcgcaggtaagcagactgccgagaaaatccgctaaacataacttccatggtacccgtaccgcaaacggacacacgtagtcgggttgaatatactaaggcgcttgagtgaatcacggttaaggaactaggcaaactgaccctgtaacttcgggataaagggtccctcctcgcaagagagggcgcagagaataggtccaggcaactgtttaacaaaaacacagggctgtgcgaatatgaaagtagaagtatacagcctgacacctgcccggtgctggaaggttaagaggagatgtcatcgcaagagaagcattgaattgaagccccagtaaacggcggccgtaactataacggtcctaaggtagcgaaattccttgtcgggtaagttccgacctgcacgaatggtgtaatgatccggacgctgtctcaaccgtgagctcagtgaaattgtagtatcggtgaagatgccgattacccgcgatgggacgaaaagaccccgtgaacctttactatagcttagcattgaatttgggcacgcgatgtgtaggataggtcggaggcaatgaagcaggcacgccagtgtttgtggagccgctgttgaaatacgaccctttgtttgtttgaattctaactcccggatggaggacattgcttggtgggtagtttgactggggtggtcgcctccaaaagcgtaacggaggcttctaaaggtgccctcaggacgatcggtaaccgtccgcagagtgtaatggcaaaagggcgcttgactgggagacagacaggtcgagcaggtaggaaactagagcatagtgatccggtgtttccgtatggaagggacatcgctcaaaggataaaaggtactccggggataacaggctgatccctcccaagagctcatatcgacggagtggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgtatgaaatttgcgtggctctgacactagtacgagaggaccgtgttggaccgacctctggtttaccggttgtgccgccaggtgcatcgccgggtatctaagtcgggatcggataagtgctgaaagcatctaagtacgaagccggccacaagattagatttctcagggtcgtcaaagacgatgacgttgataggatgcaggtgtaaaggtggagacaccaaagccgagcattactaattgcccgttcactttccttgaaataaggatggatgatatatactttcagctttgaaacaagtgctggaattgcttgcttgtgagtcatgaatacataaaacgatattcaggtgactatggcacgaaggttccacctcttcccattccgaacagagaagttaagcttcgtcacgccgatggtactgcgcaagtgggagagtaggtagtcgccgtcttgaagaggtcctgcagcaacgacgctgcgggacctctttttatgcccggacgcgacggggaactccaatttgtattagaggcatagttgtacttgatgggtaaacagctgaatattgtagtcacaatttgtttgttcaatggagtatccattgaaatcttttcaagtaggtgtataacccatctggcaatacagattttgagaatactcacatcgtggaccctcaccgcaagagggcatcaaattcatggcattttgatgagtatagttagttattctatccccgtttagatgcggacattgaaagtccgtagagtagtgccaattatatctctatttttatacaaaattgcccctctctgtttcaccctgcaatagagggtgaagtagataaggggcaaaccttgctgatattttaagtctatttaatcaatatgtccattaatgcttggttggttatttttcccttattccagcggtcagcaaatccgaactgcgcactatattcccacaccgcatacgggatattgttctgccgtgccaaatcgaccacgtcttttagccatgccaatctgatattttctccacagttcaccaaacagccaaattcacccaaatagagcatcaatcctttggacttggcgtaagctatagcttctgaccaagtctgccgcatccattcctgatcataagaatggtgataaggttctactacggttttctcctcgtcagataatttattataaacgtcgtccggaattaattgtccgggatatttcatagggccatcgaagttcaaaatacgcaaaggagtccaagaagcctggtaatgggtaattaataatggttcatagaagtggaaagaaagtatgatattcttatccccttccgggactttaatgttttttacgtgagctacgttgttttgcatattggctcccaatactatgacacgatctttttctgtctgacgtatcattttcacaatccgtagcatcaaattcgcccattgttcatcggtaggagctactgcttcattcagtagttcataggccacgtctgttaccggatattggcgtaacagattctgaattactttccacatctctactaacttgtcttgctcagcagggttgctccataaagcagcatgtgtatctagaaaatggtgggcacggatgatatgcaaatcgaaaatcacttttagattatactttaggcaagtcttgattgtgttatgcagaattttgactgtgctttcatttaatgtcatgtcttcattaaaaagttgtacctcgtcaacaggcagacgtatatggtcaaaaccattgtttaccaacaacttgatatcatcctcagtaaatattttctcacgacgctcatccatgatagttgactgcgagagccaaataccgatattcacgcctttttggattttaaattccgtctgtttcttggcatgtgtacacggtgtacacagcatcaaaaaatagacaatgaacattaaaaatttagctaaagatttcatgtttattcttgtataattagtcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgattagttataaatcaaataaaatcacatgaatgaaggaaatatccatactattacttatacttaccctattgaaaactagatattgcccccattcatgcaattattttttagttaaaacaagactctatatcaataacctggattctggtcttccgggccaatttctgaattcgttagaatttcaagtgcaggaattggatataattctctgtttgagtcataatcaaacgtacggggggtacggggcagaccatctttcgtatagtacgatccgtcattcttcggatattccgcatctagaaagtcttttaccatgtttgtgcggcataggtcgtaccagaattcatactccagcaagaactcatgacggcgttcaatggttaatgccactttccacacatcggaggtataacctttctctgttttatactgtgtataataagtctgtgcatctggtacgtctacaagttccgtattatatttcaaagtagaacttgcatactgttctgatgggcttttcccaacttccagattaccccacgcacggttacggatcatgccgatgtacttccagcctgttacaggatcattcgtctcaaaacaacattccgcataattcaacaacacagatgcataacgcatgtgaatggcagaaattggcgtatataccggattatctgccgtgtgtttccataacttcaagcaataattgttcggcaagtgattggaagactcccaatctccggcataatcaggatttgctcctaccgtctgccccgtataggggttggtttcaccgactgccaccactgaatattgtcggcgtttgtctcccggttcaaaagagcggcagaattcatgggaaacaaaagttccgccccaaccgccatattccgctggagctgtcaggtaaaagccccaccatacatcttctgtagaactggtagcaccccaacccaaatcagcccaatggtagaaggaaacttcccatatactttctttctcccaatagtgatccatctggtataattctccaaaactaggaagaagttcgtacgtaccgctctcaataatctgtttatataagctcttggctgtttcaaaatctttcatgtacatgtatgtccatgctgcgtatgccaaagcagctcctttagtgaatcgtccatattctccgttctcaggagcccagtccagatacgttgcggcaaaatcaaagtcgtcaagaatcaattgataagtttcgtccatcgtttcgggtcttggttttgacggagtggtagaataagtttcacctgtttccaacatgggtacgcggccaaaattctgtgataaatataagtaataatacccacggatggcatgtgcctgtgccaaaattttattcttggctgtttcaccatctttgaagatggaagggtcggccttttctacttccgacaaaaaagtattgcaacggctgatagcgcggtaacaaatcttccaagcaacttggaacatgtcctttccggccacccaggagtgagcccagaattccttgtcccagccaccgccacctacatccatggctgggaaattggccaatgcatgctggggtttcatgttccagctttgtgcaatatctaggtcgaatgcatcagcatgcttatccggtaggaacgtatcatacaacgcatttaatccctgatttacatattcctcagaggagatcagtaattcgggttccaaaatctcataacggggaacctccaaaaaatcttcaccacaagatgttgtcattagcaatgctgcagcaaatacggttgtcaaatatatctttttcataagtataattttttattacgttacttaaaattgaacactcaagccaatattgtaagttcgcgggaaaggataacggccatagtcaaaaccagtttgtaatacactcgaattaccgatttcaggattaccgtatttattgtatccggaaattgttgctaaattgtctatacctaaataaacgcgtacattttccatacgtgcagctttcacccaatttttcggcaaagtgtatcctaattgcacgttaccaatcttcacaaagttgccattcttcacgtaaatattagatacacgtacgttatgattctggtcgtcgcgagtaaggcgggaatagatacctgtaggattctgttcgctccaagcattctccatatagtcaactaagcagttctgataaccggaacgagcattgtagatagtattcaggcgagctgcggaataagacaagatgtcttgtccgaatacaccgtaaatgttggcagagaaatcaaaagctttgtagtttactccaagggtcagaccgaagttgaaggtcggatagccattgccaagaattgtacggtcatcatcatttacataaccgtcgccatttatgtctttgtatttgtaatctcccggtttgacagcattattgccaaactgataatattgggtactaccatttgtagcagcggccgcagcggcattggctgcatcaatttctgcttggttctggaagatgccttctactacccaaccatagaaagagcctactggatatccgttgcgggtaatgctgtaattgtcccaatagtaaccagtatcgacgttacttgattcaaagatatcgtcaccaacatttacagcttcgttctttaaagttgagccagttaatgtagcgttaatgctccagtcttttccaatttgcgtattgtagttaattgaaaattcaaagcctctgttacggatttctccggcattagtatatacgctctcaaatccggtagaaggacggacagccttgtaaagtaacaggtctttggctgaacgaataaagtaatccatcgtaatattcagcttattgttgaagaaacctaaatctagaccaacattgaattgctcattggtttcccatttcaggttcgtatcgacttctacttccttggcaagtcccggagctgtaacggttgccccgttcttccaccaataatacatcatgtattgggaagttatttgttcaaccgacaaattggttgcattacctgcattaccagtttgtccccagccgaaacggagtttcaaattattgaatagtccaaggtttttgatgaattcttcttcagacaagcgccatgccaatgatgccgaaggaaatgtaccccatcggtttccggctccgaagtttgacgaaccgtcccgacgtactgttgccgtaagcagataacggtctttcaacgtatagtttaacctaccataccaagacacaaaccgtaccggtaatccgtaaccgcccgtcacatttttggaagaaggttcggtagtcaactcaatccgacgaatgttaggagctggcatattgtaaccgatgccatataaatccttgctacgagtactattggcagaataaccagccattaagcctaaacgatggatattcttggtcaaatcatacgtgaaataagattcgatccccactgtattgtaactgttatgactcatagaaaagttatccggaagattttccgcataagcagttctcggatttactggtgaatatgtatcagattctcgctcattattattataactgaataccgtatgaaatttcaggccgtctataatatcgatatccaagtttgcattagtcagcacttggtggtagcggttccgactatcacgttccattgctgcggcatacagattatctgtgtttttttcgatatcaccggcggtttctttcttatagtgtccccatgtaccgtccggccattggataggcacattaattaaagttccggtttcatcaaccgtatccatcgacgggatagccgccgcaaaatcgtaagcattaccactgccttgataatggccatacacaaaagctacacttgcacccaaatggatgaagtccttcactgtatgtgtcacatttaatcgtgtggtgaaacgttggaattgtgactgaacgacaattccttcattatcaaggtaaccgaaagatatacgtgcttgtgtattctccgtaccgcccgaaacagacaagttataattttgctgcaaagctgcacgtgtcattacatcctgccaatcgatgttatgcaagcggctgtccaatgatggggttgcccaagcctgttcggtaaaaggtgttccatcgtgctgcttggctatgcggacagccttcacaaagtcttggatggttcctacattcaagctgttggtgctttgactaataccccagttggctgtaatgtccagacgcgcttttcctttttgaccctgcttcgtggtaatcataattacaccgttggcaccctgagaaccataaatggcggtagccgaggcatcttttaaaatttcaatgctctcaatatcgctgggattcagaaaatcgatacttgtccccgcttgtacaccatctactacatacagaggatcagccgaaccgtttaccgtagctacaccacggattctgatggttgttccaccacgtggatcacctgagttacgtaatacctgtacaccagctgccgcaccttgaagaccttggccgacgtcgataggattacgtttcattaagtcctcagatttcacagaggttacggaacccgtaaggtctgatttctttacaacaccgtaaccaatgactaccacatcatctaacatttcagtatcatccttcaggacaatacggagagcaggagtggtcgcagtaaccgcgatttcctgagttttataacccatatacgaaatctccaaagttccaggtttcggtatatttaagctaaagttaccatcaaaatcggaaacaacaccaatcgttgtacctttcaaaagaatactcgctccaataatagcttctcccgcagaatctacaattgtacccgtaaccgtaaacgactgctgagttgtttgtagatgtggtttttccgtcctaaaggtagcatttgcacttgccatttgtcctgttcccaagagggataacaaggtcaaacataccagtttttggctcaaatagtttttcataattttacttgatttaaattaacaattataggttaagaatgttattcactgatccattcatctgccataaatcccatccgactgttgtgatacggacaattccacaggctggctttaggctcattgtaacggggaattccatcagcagaaaccgtgcggaaccattcaccgcattctcggtctatcatcttttctttgatgaagttccacgtatgtatggcactgttcaggtaagatatattacctgttagttgccaggcattgatgcagcctaccacagtctccgcttgacaccaccatgaaaaatagtttctgatactgttgccacgtctttcatacatcatagctcctgttgccgtgtcaatgccttctttcaaggaagtatccacaagtttcaaagctatttctttgcatttgtcaaaaacttgcggatcacctaatgtctttgcggcctctattagcagccaggaggcttcaatatcatgaccgtaagaatctatgtcatccagattattccagtttgaatcgcaagatggaattaggtggtgtgtatgggaatcatacaaataggtagtcaatatgtcaatcaatttacttaatcgtctgcgtaagccattgtctctccataccttatataaagaagtataagcctccaatacatggatatgggtcaatgtcttggttgcatttgggttgccgtcgaaaccttgtctcttaggaattccccacttacgggtgaacgattctatgtacccgtcctttgtggggtcttttattttttcttccatgattctataaatatcaatggatttttgcaggctttccagattaccggttgccctgaaatgttcagacaagccataaatggcatacgcacatgcgcaggtttgtttatccgtttctaacggtgtgctatctgctttaacagaccaatatacaccgccatactgaggatcaatgaattgattaatgaaataatgttgcgcgcggtctgccaactttttataagcttcattgccatacaggcggtaggccgttgaaaaagtccataggatacgagcattcagtacgctaccttttggagcatccattaccggagttccatctctccctaccattccatagaaacctcccgcagggtcgacgatatgtttctcccagaagggaagaatgttgttttttaggtccgatacgatttcactgcgtaaaacatcaataggtatggattgtgctttcgcagaaaaatctgttatccacaataatactgcggtgcaaatgaaaatgagaaatctgtttttcatagtggtaatagctatacttctcaactttgtatatggcaaatttatgtttttttattatcctattatgttaagcctgcttcaattttaatgacataaatgtttccaaaaaagtatatatttgaatccatacctcggttatgatacaaataagtatgtcatactataaatatgacacctatcgtctcttttacagcttactttttttgaatagatttgtaatctgtttaaacgaaatatattatgaataaatcaactcccttttccatttgtattctggtactatgcataaataccatatttatatctactcgtttacaagccaatgttatcgagcaggttatgtttaggcaaatcaccacctcggaaggtctctccaataacaatatcaactgtctgtaccgagacagccggggattcttgtggataggtactaattctggcttaaatcgttatgattcctataatttccaacaatattaccaggacaccgacaatctacccgataaccgcatcaacaacatctttgaggattgggacggtaatatttggattggtactgaacaaggttatgctatttatgactacccaacaggcaaattcgatcctaattgtaaagaccggattcataatattcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtaatattaatatattttgcgacactatctccatggcaggaatggaccgtgaaatgaaatatctatgggtacatgacgatcataaaatctacttgtattatcctcggcagaaaatgacaaaaatatatccactgatggacacttctatttccgacctttttgtcacaggcaaatatatttattctatttacaatgatggaaaactatatcttactgatattaactcgtcactcaatcaggaaatccatattccgtacgaatatggggacctgctgagaaagcactatcccaaaatttatgtagaccgtaacgacggcatctgggtacacacttttcagaatagcctgctcttatataaaaaaaatctccagacggaatggcaagagattaaattgcccacccacaacgaacagttcaaccggattcgtaccattgcagaagattccaatggaaatatgtggctcatcactagccaccttggtgcatttatttatcaattgcaatcgggtgaccttactcaatttacacataattcgttaaaatctcatactcttgccagtaataatctcagcgccatacacatagatagggaaggtattgtttggataggtaatttcaggcatggagtatcttattatgtaccccagtcgcaagtattcttgaaccagaaactatatcagtataatgaaatcatttcattttgtgaagactctgtttccatttggtatggaacggatggcggaggactgatgcgccaaatgcataacgatccgatgccccagcaaataaccacacctgcaaacgtcattattaccatcaagaaagatagtcgggacagactatggttaggcagttttcaaaacgggctactttgctacgatcacggtaaaataacccagtacaccagtcggaatagcggactgctgagcaatgatgtctacggcatacaggaggacaaggagggaaacatattggtaggactcctgaacggtaatattcaaaaactggatatccggacacaaaaaatagaaacccttttcagcaagcaaggcaaatatggcatcggggaactactatacatcggcaacgacaccttgtttgctgccacttcggtaggactcatgtatcttaatacaaataccaagcagttccattttataaacaaaaacaaaaggaacagccaaatattggaaaaacagtccctttataccatttataaagatagtcgaggtatcctttggatgggtggaagtcaaggtcttgcctggtggaatctccatactgatagcataggatatataaatcataacaatggtttgtctgccaacatggtaactgccattgtcgaagacaataatcggcagatatgggtaggaacctgcaatggaattgcccgcattaacctgtcacaaggaacgttcaatatcaccaactatgacgtggaggacggaattatctcaaacgatgtcagcgaacgagctttatataaactgcgtaatggtaacattcttgtgggcacccctaatggttatactaccatcattccacaagagatagttcacgatacctataaagcgaaagtctaccttacagatatcgaaccacagtattactccttgtcgcaaatgcttaacggcaaatctcccgaatgtgcctccgaaatcattttagagagagaaatcccttctttacggctctatttttcgaccctaaactttattgaatcgcgcaaaacacgctatgcctatcgttttaagggacaatcaagccaatggaactacaccgctgacaatcagatagaactttccttgctcccaccgggtaaatatgaactacaagtcagagcatgtaattccgaatgcatgtggtcacctgatgttaagaccctcataatacacatcttgccaccttggtatcggacatggtgggcttattgtctcttcacggtcgccattctggcggttgtatggggattcatcgtccattttcatgtcaaacgcaaaagaattgaagctctgaaagctatagaacaggaaaacgaacgccaacagagactgacagatttgaaaatgcaattctttgctaatgtcagccatgaattgcggactcccctttcgctcatcatcaatccgcttgaggagtttttaaacaaatacccacagtacaaaaacagcttgctttacacagtgcagaataacgctcgttatctgttagaactgataaaccaattgcttaatttccgtaagctagacgctcacggagagaccatccaatatattcatagtgatatcgttcgtttggtaaaagaccagtttcagtcgttcgaaagcatagcccaaaagaggggtatcagttataagtttaccagtcagcaacctagtattcctatggattttgactatgacaaagtacgaaaaatagtcatgaatctgttgtctaatgcctttaaatttatcgaagatggtggcagcattgaaatcaaaattaatatcgtggcaggtaatgttgtgatgcaattctgcgataccggatgtggtatcgatgccggtcaacaggaaaagattttccaatgtttttatcaggcagaacgtcgggaaaaccacttaggtggaagcggaataggattgtacctcgtagccgaatacgtaaaaatgcacaagggaaacattcaggtttccaccaatatccccaaaggaagtatctttactgtcaccctgcctatgcacaccggtacacaatccatgccacaagaggttactagcaatgaaaataaaaatcttcagacgccatctacggggggaactgaatacaactatactattctattggtagatgataatagtgattttcttgacttcctgagtgcttgcctttctactagctataatgtactgaaagcaactaacggaaaagatgcgttggaaatactgaaaacggaaaacgcagacattgttgtcagtgatattatgatgccggacatgaacggattggaattgtgttccactatcaaaaacgatatccttacttcgcacattcctgtcatcttgctcacagcccgagccagtgaagaataccagctggaagggctgaataacggtgcagacgactacattactaaacctttcaatatggagatattgaaactacgcatcagcaagctcattgaaagaagtttaaaaaagcatgaactgtttgacgaacaactgaaaatagaaccaagtcatattgccatcacaccccttgaccgccagtttgtagagaaagccatccaaattgttgaagacaatatcaataacgccgatttttccgtagaagaattagctgagaaattaaatatttcgcggggatacctgtacaagaagatcgtcaagctcacaggtaaaaacgctctcgaattcattcggctcatccgcatgaaacgtgctcagcaacttttgacagaaagtcagctccaaatagcagagattgcctataaattggggtacaactcacccaaggttttcaccaaacattttaaggaaaagtttggtatgactccatctgaatttattcgccaacaaatcggagagaaggcaggtaaagccagacaataaatcttaaatgggtaaaggaagtagataaaaattggattggtggcatattattaggggaaatagattaccaaatatccgtctggaaaagggaaacgaatgggaatacacatacaatgacgttaatggatacaaaagaaggctgtccgtatatatttaaatctgtattttagggcagaaattaacaacccaaatttaatatgtcatgaaaaagaaacttttctccattgcagcagtttttgccttagcttcctttggttgcctggtacaagcgcaagagtttaagctaacgccttcaggttattttaagaattacggagtggatattatggctttcgacgatatctatcccgaagggcatcaaggaggtgtgtgtatcattatgaatggtaatcgtgtggcaaccaacggtgacattcgctttgaagccacaccggggcagtggcagcctgtacccaagcagctgaaccgcaagttgggagaaaatagtattaccgccacattgtgttatcctgactcgtcgcgtcatctgacgggattcaatccgatgatttacccggactttcaattcaactatacagtgaaagtagaagggaaaggagatcatgtggaagttactgtagatttggaccgtcccgtaccacaagaatttctgggtaaggtgggcttcaacatggagttttttcctggagcgctgtttggcaaaccatggattatggacaaccagactggcatttttccacaacagcctaactcaccgctggttactaccagtcctaattacttgcacacgggtaattaccacccagaaggccagccgttggcagacatggctaacttgattggcaaaggctatagccctattgttgcagatgacattattagtaagccgtatgctatgggtaagaagttcacttctcgtcccgatgatccctataataaggttactattgagtccttgtccggagatttaaaactatatgatggtcgcatgaaccataataacggctggtttgtactgcgtagcgagattgcaccgggtgttaccaagaatgccgtgaagtggattattactcccgccgtgatgccagactggatatatcggcctgtcattcagacttcacaaataggttatcatcccaaccagcctaaagaagccatcattgaaatggatactcgtaataaccgtcaggctatggcacaggtggtacgcatcggatcggataaggaagagatagtgaaaaccgtggttcctgccaattggggaaaattcctacgttacaattacttgaaagtagactttagtgaggtaaaggaaccgggattataccagataaaatatggtgattctgtatcacctattttccgtatagatgaaaatgtgtacgatcgtggtgtttggcaacctgtattagaatacttcttgcccgtacagatgtgtcatatgcgggtaaatgagaaataccgtgtatggcatggcacttgtcatatggacgatgcgcgcatggcacctgcccataatcatattgacggctatgaccaaaaaccgggattgtcaaagtatagcgcaggtgatttagtgccgggcgtgaatatcggtgggtggcatgatgcaggcgactttgacttacgtgtagaatcgcaggcaggcgaagcatacatcctttcgttagcttacgaggccttccatccggaaatagatgtaacgtccattgattatattaaccgtgtaacggaaattcatcaagctgatggaaagaatgatcttttgcaacaagtggaaaatggtgctttatctgtagttaactcttatctggcattgggacggctgtatcgtggtatcatctgcggaggacttcgccaatacgtgttgttgggtgatgctgcggctatgactgatggtaaacttggtaacgaggatgaccgctggattttcactgaggagaacccgaaccgtgaactctccaccgctgctaatcttgctgctgcttcgcgagtgttgaaaggtttcaatgatacattaagcgtacattgtctgaacattgcccgtgagatattccaacgtaccgaaggcgataactcgcgcatagcatcatccaagatacaagcagccgtagagctttatctggctaccaatgaagacttatataaggattttctacttgataacgaggaacttatcgtgaaacaaatcggacaaactggttggtataccgcccgcgtggagcaacgttttgcccaaatgaagaatgtgaaggcacaagctttttctaaggactttcgtaaggctttggtggcttacaaggaacagttggacaaggaagtcgtttccactccttatggcgtaccctatcgtccacacatctggggagcaggctgggatatccaaggcttcggtttccgtcattattttctggcatcagcctatccaaatatcttcgataaagagcctatcttcaatgcacttaattttgtgttaggatgccatccgggcagcaatcaggaatcttttgcctcgggtgtgggggcagcttctgccactattggctacgggttgaatcgtgctgactggtcgtacattcctggcggcgtgatttctggtacagcattgatacgtcccgattttcctgagctgcttcatttccccttcttgtggcaacagaaagagtacgttttgggaggtggctcttcacattatatgttcttagtattggccgtacaacagatgttaaaggaataatgactctattcgcaatgtgaaaactgcagtatgttattattccacatcctaaaaacatttatcgataaggtgaggagatggttgttaagtcttacctcatggtaaagataggattctggatttgccttaacatccaatgcctttgactagaggacatacttgcgaatatcttaatgaaaacctactattaaacagtgtactagtcatggattacactttggaggtggaaggttgccggaaacagaaccagccgtggtatatgtaggtaatttgtctgataacctattcctaaaacagaaaatcacgctggtacgataagagtctagttggctttctcacaaattgaaatttgagtattcttttaaaaactaaagaaggtcgtatcactactcaatacagagtttgatacgaccctttttttatattatagttgcaatctgtaactttgggagatggctatttaaactttaaacactcctaatttgttaatctgtttgttacgttatggttaatgaatcagcgtatttatgccttctacaatattcccattggagaatacacatcttacattgatatctttatccatgataacaatgtctgcatcttttcctttctgaagagtacctttatggtcatcaattccaataagtcttgccggagtttctgaagccatacgaacagcgtctgccaacggtatagcagctttcttgaccattgtctgtaccagcgtatccatggtagccagacttccgaccagtgccgaatgatcggctagtttgcatacaccgttttcgatgatgaatctcgggtcaacaattggttccccatcgtatgccgcatacttcaaggcatcggttaccagacaggtctgctcaacacctttcaatttatacacaagcttcagaatagttgcaggcaaatggattccgtctgcaatcacttctacactcattccatctgtcaggtatacactttccactgtaccttcatatttgtattcccgacgcttgtggaaccctggcatggcattataaaagtgagctgcatgtgtaaagccagcctcaaatgctgccttaatttcaggatattctgcttcagtatgggtaatggcagtcaggataccttttgaatgtgtatatcgggcaaaatcatgtgctcccggtagttcaggactaatgtcccagcgcttgatgcactttgtactttccaaaagtggaatatattcgtccggatcgggatcttttagaaattcttcccattgtggtcctgccatttttttgttcaggtaaggtccttcgatgtgtaatccctgtatcgtacttcccgattctttcatcaattcttcgcatgtgtgaacagcttttctgatattatcgaagctggtggaagagagtgtggggaaaatagaggttgctccatgtttcagatgtgcctgaacagcttgttggaatgcttcgggtgtactttcggtgaaatcatgtccgcctcctccgtgtgcatgcatgctgatgaatcccggtacgataaacattcctttggcatcgatgatctttgcgccgataacagccaggtcgctattggttacttctaatattttgccgtcgctgatgaggacagaaccatctttcatccatccctgtggagtgaggatatgtccatttataatttgtgtcaacataaaagccgagtatttaaggttggttaaaataatttattggtgccttctaccagtttacccattgcccatacagcacgtacatttaagtcacggtcgagagcaatgatatccgcatcctttcctttctccaatgtaccttttcggtcgagtactcccatgatacgtgccggagtttctgaagccattcgtacggcatcttccagtggtatttcagctttttgtaccattgtacggatcaggcggtccatggtagcaatacttcctgccagtgcagaacggtctgccagcttacatactccgtcttcgatgatgacacgtggatcgaatgcttctttgctgtcgcttgctgcacaagccagcgcatcagtaatcaaggcagtcttttctactccttttatcttatgtaccagacgaaggattgttggaggtacatgaataccatcggcgactacctctactgtcatgtcgtccatcagataaatgctctctaccgtaccttcatatttatattcccggcgtttgtggaagccaggcattgcgttgtagaagtgggttgcatgagtatatcctacttggaatgcagtataaatatcttcaaattcagcttgcgtatgtcctactgctgccagaacacctttggatgtgatgtatttaccgaattgcattgctcccggaagttctggtgctgcatcccatcgtttgatgcagtgagtttcttccagcagaggtatatattcttcagggtcagggttcttaatgttttcaggcatttgtccaccggccattttcatgttgaaataatgtccttccaggtgtagtccgagtactggactgtcaggttcactcattaatttttcggtggtttctgctgctgctcgaatcattggaatagtagaagaggaaagtgtcgggaagatacttgtggtaccatgctgcatgtgagctttgattgcggtccgaaaagcatcctcgcatccttccatgaaatctcgtcctcctccgccatgtacatggatttcaactccaccaggtacaatgtacattccttttgcatcgatgagtgttgcaccgacgattgccaggtcacagttggttacttccagtattttgttgtccctgatcaggacggaaccgtcttttaaccacccttgaggagttaaaatacgtgcattaattatttgagttaacataggaataaggttttgtttctattatatcttttgcaaaattaattaattgtacgatagatattatatttatttataattatagggttaattattttaaaagtaagcctatttgttcgtttcatgaaagatattgaatacccatcgttcgtctattgaaaaatatcggaaacgttaagttatcatttttattgaataaaaaaatggaaagactagataaaatgaattattatttgtatctttgtcgcccgatttatatagtattgcgaattgggaaagcttagtacatacaaggtagaattgaaaaatatgtcagaggatgtgtgtcgttacgaatatgtcctcgacaatgattttttcattagtatcgatgctccggaagtacagaaaggaaaactgcatgttgatctgactgtaaaaaagagtatgggagtttttgtgttgactttccatacagagggagctgtagtcgttccatgcgaccgttgtctggatgatatggagattcctgtcactacggatgatgagctgaaagtaaaaatgggagctgcattttccgatgaagatgatatcgtagtggttcctgaggaagatggctatattaatgtagcatggtttatgtacgagtttatagcattgagcttgccaatgaaacatgtacatgctccgggcaaatgcaataaggctatgatgggagctttgagcaagcatttacgtacatcggcagatgatgaggattatatggatgagatggaagaaaatgatgccgataccgatgtggagcaggaaatagatccacgttggaatgatttaaagaaaatattagataataattaaataaagttttagaaaaatggcacatcctaaaagaagacaatcaaaaacgagaactgctaagagaagaactcatgacaaagcagttgctcctactttggccatctgcccgaactgcggtgcatggcatgtttatcacactgtatgtggcgcttgcggttattacagaggtaagttagctatcgaaaaagaagctgctctttaataaacgctttgtagaacacgtttgtgtgattcactgaaagaataaagccggagagctttcggctcttccggctgtttttttataggaatatgcaaactaaaaactgaaatgatggaaaaaataaatgctgtaattacaggagtcggtggctatgtacctgactatgttttgaccaacgaagaattgtcaagaatggtcgataccaacgatgagtggattatgacccgtatcggagtaaaagaaagacgtatcctgaatgaagaaggattgggtacttcttatatggcacgtaaggctgcaaagcagctgatgcaaaaaactaattcagacccggattcgattgattgcgtaatagttgcaacaactactcctgactatcatttcccttctacagcttcaattttgtgtgataaattgggcttgaagaatgcttatgcctttgatttgcaggctgcatgcagtggcttcctttatgcaatggaaactgcggctagcatgattcagtctggcagacataaaaaagtgatcatcgtgggtgctgataagatgtcatcgatggtgaattattcagatcgtgcaacttgtcctattttcggtgatggtgcagctgcttgcatggtagaagctactactgaagattatggtatcatggactctattttgagaacagatggtaaaggactgcctttcttgcacatgaaagctggtggatcagtatgtcctccttcttattttacggtagacaataaaatgcattatttgtatcaggaaggaagaacggtatttaaatatgctgtttctaatatgtcggatgttacagctctgattgcggaaagaaatggtttgaataaggataatatcgactggattgttcctcatcaagctaacctgcgtatcattgatgccgttgcttctcgtctggaagtacctttggataaagtgatgattaatatccagcgttatggtaataccagtgccggaacattgccactttgtttatgggattacgaaaaacaattgaagaaaggcgacaatatcattttcactgcattcggcgccggatttacctggggagctacgtatgtgaagtggggttatgatggtaacaaataagaaatagaattcaatatgaacacatacaaaagaacgcatcccaatccgatgcgtttttttgtatgttactaaaaactgattatgcacaaagccggatttgtaaatattgtaggtaatccgaatgtcggaaagtctaccttgatgaacttgctggtaggggagcgtatctctattgccacgtttaaggcacagacaactcgtcaccgtatcatgggtatcttgaatacggatgacatgcagattgtcttctctgatactccgggagtcttgaagcctaattataaacttcaggagtctatgttgaacttctctgaatcggcattggtagacgcggatgtcttgctttatgtgacggatactatcgagaagccggataagaatgccgactttatggagaaagtgcgtcgcgtaaaggttccggttttgctgttgatcaacaaaatagatttgaccaatcaggaggatttggtaaagctggtcgaagaatggcatgaaatgttgcctgatgctgaaattatacctgtatcggcaaaggcgaagtttaatgtggatgtggtgatgaaacgtatcaaggaactgattcctgattctcctccttatttcggcaaagaccaactgactgataagcctgcccgtttctttgtgactgaaattatccgtgaaaagattcttttatactatgataaggaaataccttatgcggtggaagttgtagtagagcagttcaaggaagaggcgaagagcattcatatcaatgctgtgatttatgtagaacgtgaatcgcaaaaaggcattattatcggtcatcagggaaaggctttgaaaaaagttgctaccgaagcacgcaaaacattggagcacttcttccagaaatcaatttacttggaaacatttgtaaaggtagataaagactggagaagctcggataaagaactaaagaattttggctatcaattagattaacgtatcggctgtgacagccgtaaatcaataagacaaatatgggaaatttagtagcaatcgtaggacgtcccaatgtgggaaagtcgacactgtttaatcgtctgaccaaaacgcgtcaggctattgtcaatgaacaggccggaacaacccgcgaccgccagtacggtaagtcggaatggctgggaaaagaattttcggtagtggataccggaggctgggtagttaattcggatgatatttttgaaggcgagatccgtaagcaggttgttctggctatggatgaagcggatgttattttgtttgtggttgatgttaccaacggggtgaccgacctggatatggaggtagcttctatcttacgtcgttccaaaactccggttattatggtcgcaaataagacggataataatgatttgcaatacaatgcagccgagttttattctttaggcttgggtgatccttattgtatttctgcattgagtggaagcggaacaggtgatttgctggatttgattgtaagtaagttcaagaaggactccgatgagatactggatgaagagatccctcgttttgctgtggtaggacgtcctaatgccggaaagtcttctatcatcaatgctttcatcggcgaggaacgtaatatcgtgacagaaattgccggaacaacccgtgattctatttatacgcgttacgataaattcggatttgatttttatctggtagatacggcaggtatccgtaaaaagaataaggtcagtgaagatttggaatattattcggttgtccgttctattcgttccattgagaattcggatgtatgtattctgatgctggatgcaacaagaggtatagaaggacaagatttgaatatcttttcgctgatacagcggaaccagaaaggactggttgttgttgtaaataaatgggatttggtggaagaaaagactacgaaggtaatgaaaaattatgaagaagccattcgtaatcgtttcgctccgtttactgatttcccgattatctttgcttccgcattgaccaaacagcgaatttttaaggttctggaagctgcaaaggaagtttatcatgcacgtactactagaataccgactgctcgcctgaacgaagagttgcttcctctgatagaggcttatccgccaccttcgaacaaggggaaatatatcaaaatcaaatatattacccaattgccgaatacacaggttccttcgttcgtgttctttgcaaacttacctcagtatgtgaaagaaccatacaagcgttttcttgaaaatcagatacgtgaacgttggaaactttcgggtactcctataaatattttcattcgtcagaaataattgggcatttctgggcgtttgtggaaaatcttctttccagttgtttaaaactgggaggaagatttttttataagtagatagtgcattcgtacctaattatcttatgcataattgttagttgtctaaaaaatatatatctttacttatcattactacatttttggaaaggcgagagaactacaattaaatctaatattttatgaaaatctatgttttaataattgcttgtatgctatgttcgacgactgcatttgcccaatattgtagtcttcagaaaggacagaaactttattatgaagttcttacaggtgaaaagaaaatcgaaacctatacttcagtagtgggtgtggaaactaagaatgattctacttttattactttgggagattttgctccaaagatgaatgaaaagatgaaggataccttgttttaccacaaagtggcttatgcaaatggcaatacgctggtttatctacaggatgaagaatctatgaagaataatatgtttagcttgatggcagcagccttgaataaaaacgatatgactgcggcaaaggagaagtttgaggtaaacgggcagatttgtttgcttttaaatgaaaagcagaaaaaaggagataaaattaaggctaatgaaatgagtatccggataaagccagtaacgatgactgtttcgataaaaggtgaatatgagggtacagaaactatttctacaccggcaggtcagtttgattgcgtaaaagtgacttattccatgaagatgaagtttttcatgttttccgatgaaagtcagattaccgaatggtacgccaaaggtgtagggctggtgaaacatgaagaaaagagtcggaaacttgggcagaagatggtaaaaacactaacgaaaatagcggagtagcctttgttctgaagtgacttaacgaaaaaacggatactctttccatttaaccatgaaagagtatccgttttttcgtttaagaatagagaggcgattatcgtatttctttttctccttccgtctttacttttttaagcaagtcggatgcgaagataaagtcgttcaaacgttggttggttgcactgaatacttcattctttgttccttcccattctttatgtccctgataaatatataatatgctgtcacctatccccaataccgaattcatatcgtgggtattgattacggtggtcatgttgtattcggttgtgatgtcgtgaatcaattcatcgatgaccagtgaagtcttggggtccagtccggaattaggttcatcgcagaataggtattgaggctggagggcaatggcacgtgcgatggccacacgtttctgcataccgccacttatttctcccggatatttgttttttgcatctatcaggttgacacgatccagacagaattcagcccgtttgacacgttcacgataagtcatgttggagaacatgtcaagtgggaacatgacattttccagtaccgacaaagaatcgaataaggctgcactttggaatatcatacccatttcccggcgtaaggcttttttctctttcttccccatggtgatcaggttacgcccgtcgtataacacttctcctttttcgggggtaagcaaccccaccagacatttcatgagaactgttttaccggaaccactttgcccgataatcaggttggtcttgccgttttcgaagataaaattgatatcgttcaatacagtgcggtcttcgaatgatttataaagtgatttgatctgtatcattgttagctgagtatttgagtgagtattaagtcggaaaacaaaatcagcacactactgcatactacagagtctgtactcgctttgccgactgcaatggaacctccttctacggtatatccgaaataagcagatacactggctatgataaatgcgaacaccagtgacttgataaaactgcaccacacataccattcgacgaaactgtactgaaaaccatattccaaatcggttgcattggtgataccagcaaaccatgccgtacaaaaggcacctatgattcccgcaaaaatactgaatatcaccaacagtggaatcatggtcatcagtcccaatattttagggagaatcaggtatgaggctgagtttacacccattatttcaagtgcatcaatctgttgagtcacacgcatcgttccaatttcggaagcaatgttagagcctactttacctgccagaatcaaacacatgatagaagatgagaactccagcagcaagatttcacgtgtggtatatcccactacaaaacggggcatccacgggctttcaatattcagctttatttgtatacagataacggcacctatgaagaatgaaatcagcaacacaataccgatagaattgattcccaactgtgccatttcgttgcgatattgtttgagatacatccggaatcgctctggacgagcaaatactcgtcccatcagcatgaggtatttgcctaaagtcgtaattggtcttaccatattaaattgagtctaattttatgcaaaagtactgttttttagctatattataataaaagcatagacgaaaatgggtggaattaccacagaacccaagatttttactacttttgctgctgctatgaaggtcttgattcttcatgcttaattctttattaaacagctttatggcagaacaggaaaatcaacaacataatgcagaagaagcgtttgaacttccagcggacggacgcatggttcttcgtacggagaatctggtaaagaaatatggtaagcgtacggttgtaagtcatgtttccattaatgtgaaacagggagagattgtcggactgctgggtccgaacggagctggaaagacaacgtccttttatatgacgacgggattgatcgttcccaatgaggggcatatttacctgaacaatcaggatattactgactatccggtatacaaacgtgcacagaatggtatcggatacttggcacaggaggcttcggtattccgtaagatgagtgtggaagataatattgcttccgtcttggagctgaccaaaacctcgaaggagtatcagaaggaaaaactggagagtctgattgcagagttccgtttgcagaaggtgcgtaagaatttaggcgaccagttgtcgggtggtgaacgccgtcgtacggagattgcgcgctgtctggccatagacccgaaatttataatgcttgatgagccctttgccggagtcgacccgattgcggtagaagacatccagcatattgtatggaaattgaaagataaaaatatcggtattttgataaccgaccataatgtgcaggaaacattgagtattaccgaccgtgcttatctgctgtttgaagggaagattctttttcagggtactcctgaagaacttgccgaaaacaagattgtacgtgaaaaatatttgagtaacagcttcgtactccgcagaaaggattttcaggtaaaggatgtacgggaataagttgccagtgtttgtgtaaagacttaaatagtgaaacactctttgtgttttttgtaatttttacttcgacattttggtttttgcaatattaaacactatttttgcacactctttgaatatatttggaatatagtaataattaaataaataagtcggaaatgaatatttcattgcaaaacgtagacaaggtaagcgctgtgcttactgttcagattgaaaaggctgactatcaggaaaaagttgaaaaatcgttgaaaactctccgtcagagagtaaatatgcccggattccgtaaaggtatggttcctatggctttgatcaagaagcagtacggtacttctgtattagtagaagaagttgacaagctgatgcaggaaaaagttggcgaatacattcgtgaaaataatgtaaacatgctgggtactccgctgccgaaagaaaacaacgtaaatttcgaaactgatgaaaactttgagttctctttcgatatcgctttggctcctgaattcactgtagaattgtctaacaatgatactattgattactatgatatcaatgtaacagacgaaatggttgaccagcaggttaagatgtatactcagcgtactgcaaaatacgataaagttgaggaatatcaggacaatgacatgctgaaaggtctgttggctgaactggatgaaaacggtaatacaaaagaaggtggtcttcaggtagaaggtgctgtcatgatgcctacttacatgaagaacgacgaccagaaagctatcttcaatggtgcaaagacaaatactgtattggttttcaaccctgcaacagcattcgacaacaacgaagctgagctggcttcattgctgaaaatcaagaaagaagaagttgcaaattacaaaggtaacttcagcttccagatcgaagaaatcactcgtatgattccgggtgacttgaatcaggaactgttcgaccaggttctgggtgaaggtaaggctcacagcgaagaagaattccgcgcacagattaaagaaacaatcgctaaacagtttgaagctgacagcgactacaagttcttgatcgatgttcgtaactatgttgttaacaagatcggtaaactggaattcgcagacgaactgatgaaacgtatcatgttggaaaacaacaaggaaaaaggtgaagagttcgttgcagaacattatgaaaagagcattgaagaactgacatggcacctgatcaaggaaaaactggttgcagcaaacaatattaaagttgaacaggctgacattaccaacatggcaaaagaagcaacacgtgctcagtttgctcagtatggtatgattaatgtacctgatgaactgttggaaaactactctaaggaaatgttgaagaagcgtgaaagcgtggaagcactgatcaaccgtgttattgaaacgaagttgtcagaaatcctgaaaggtcaggttacattgaaccacaaagcagtttcagcagaagaattcaataaaatgtttcagtaatttccccgcggtaagctgaggcgaattgctaaaacttgctaaaagaggggcttttggtctggctttcgtccgattgaacagcagtttttgtacttttgttctatatgggaagaagcgatcagaagcttctcttttattattttattattcacatttatagatttgactaatggacgattttagaaaatatgctaccaagcatttgggtatgagtagtatggtgcttgacgacgtaatcaaatcgcaggcaggatatcttaatccttatatcttggaagagcgtcagttgaatgttacacaactggacgtgttctctcgtctgatgatggatcgtatcattttcctcggaactcagatagatgattatacagccaatacactgcaagctcagttgttgtatctggattctgtagactctggaaaagatatctctatttacatcaactctccgggcggatcggtttatgccggactgggcatttacgatacaatgcagttcatctccagcgatgttgccacaatctgtacaggtatggctgcttctatggctgctgtattgctggttgccggtacggaaggaaagcgttcggctctgactcattcgcgtgtcatgattcatcagccgatgggcggagcacagggtcaggcttctgatattgagattacagctcgtgaaattcagaagttgaaaaaagaactgtatacgattatagccgaccattctcatactgattttgacaaggtatgggctgattctgaccgtgattattggatgacggctcaggaagctaaggaatatggtatgattgatgaagtgctttctcgtaagccgactgtgtaactatttaatttaataaaaagctatttactttggaagataaatcaactaagaagagcaaaagacgctgtagcttttgtggacgttcggaagatgaggtcggtttcctgataacaggtgtcaacggttgtatctgtgacagctgttcggagcaggcacatgaaatcgttcaggaggctatgcgtcagaaagggagcaataccgacttgaatctggcagagcttccgaagccgaaagatataaaagacttcctcgatcagtatgtgattgggcaagacgatgcgaagcgttatctttctgtggctgtttacaaccattacaagcgtttgttgcagccttcgtcgaaagatgatgtggaaattgaaaaatccaatatcatcatggtaggaagtacaggtacgggaaagacattacttgcgcgtaccattgccaagttattacatgttccctttaccattgttgatgctacagtactgacggaggctggttatgtaggcgaagatatcgaaagtattctgactcgtctgctgcaagtcgctgattataatgtagccgaggctgaacgtggcattgtctttattgatgagattgataagatcgcccgtaagggagacaatccttctatcacgcgtgatgtgagcggggagggtgttcaacagggactgttgaaattgttggaaggctctattgttaatgtccctcctcaaggaggtcgtaagcatccagagcagaaactgattcctgtcaataccaagaatattttgtttatttgcggaggagcgttcgacggtatcgagcgcaagattgcccagcgtctgaatacaaacgtagtaggttacggtgctgccaaggaaaaggttaaaatcgaccgtgcaaatttgatgcaatatattgctcctcaagatttgaaatcttttggacttataccggaaatcatcgggcgtctgcctatattgacttatttgaacccgttggatcgtactgcattacgcaatattctgaccgagcctaagaattcaatcatcaaacaatatatcaagttatttgagatggatggggtgaagttggagtttcagccagaggtattcgattatatagtcgacaaggctatcgaatacaagttgggtgctcgtgggctaagatcgattgtggaaacgattgttatggatgctatgtttgagatcccgtcgcataaggtagattcttttgttattacgcttgattatgcgaaagagcagatgaataaagccaatttgtcccgtttacaaatggcctgaaaaactaaaaaagtgatgaggaaataaagttcttcggtaaaataattgctcgattatttgcataatatcaaaagttgtttataactttgttacatacgcataaagcgagacttatatcttgaagaattaaaatcactaaaataaaaggacaatggcggaaaagattaatttggcggaacagttgaaaaagtattttggtttcgacacttttaagggaaaccaagaagctataattagtaacttactggccgggaaggatacttttgttttgatgcctaccggtggaggtaaatcgttgtgttatcagttgccttcattgctaatggaaggaacggctatcgttatatctccactcattgccctaatgaaaaatcaggtggacgccatgcgaaacttcagtgaagaagacggagtggcacatttcatcaactcatcacttacaaagtcagcgatagaacaggttaaatctgatatcctggccgggaagacaaagctgctgtatgtagctcccgaatcgctgacaaaagaagaaaatgttgattttctgaaacatgtgaagatttctttctatgcagtcgacgaagcacactgtatttcagagtggggacatgactttcgtccggaataccgtcgtatccgtcctatcatcaatgagatcggtaaggcaccggtcatagcattgacggctacggctactcctaaggtaaaaatggatatccagaagaacttggggatggtaggggctacggagtttaagtcgtcattcaatcgtccgaatctgtattatgaagtacgacccaaaaccaataatgtagacaaagatattatccgcttcattaaacagaatccggaaaaatcgggtattatttattgtctgagccgcaaaaaggtggaagagttggctgaaatccttcaagcaaacggcattaaggcgcgtccttatcatgctggaatggattcggctacacgaaatgccaatcaggatgctttcctaaaagaagacatcgatgtgattgtggcgacaatagcatttggtatgggtattgataagccagacgtgcgttttgttattcattatgacataccgaagagtctggaagggtattatcaggaaacaggacgtgccggacgtgatggaggagaaggtttgtgcataactttctattcgaataaggatttgcagaagctggagaagttcatgcaaggtaaacctgtttcggaacaggaaatcggaaagcaattgttgctggaaacagcagcatatgctgagtcgtctttatgtcgtagaaagattctgttacattatttcggagaagaatatacagaagataattgtggtaattgtgataactgtttaaatccgaaaaaacaagtggaggctcaggattcgttatgtgcagtgattgaaacaatcattgcggtaaaagaaaattttaaacaagattatatagttgatatccttttaggaaaagaaacatcggaagtcttggcgcacaagcacgaagatttggaagtctttggctcaggaatgggagaagatgaacgtttgtggaatgctgttattcgtcaggccttgatagccggctacctaagtaaggacgtagaaaattacggtttgcttaaggttactcctgaaggacataaattcttgaagaaaccgaaatcattcaagattgttgaagatgtagattttgatgaggaagaagtagaagaagttccgatgcgaagtggggcatcgtgtgcggtagatccggtacttttctccatgttgaaagatttgcgcaagaagatgtcgaagaaactggatgttcctccttacgtcatcttccaggatccttcactggaggccatggcaactatttatccggtaacactggaagagttgcaaaatattccgggtgtaggggctggtaaagctaaacgctatggtcaagagttctgcgaactgatcaagaagcattgtgatgaaaatgagatcgaccgcccggaagatttgcgcgtgcgtacggttgccaacaagtcgaagctgaaagtttcgatcattcagagtattgaccgtaaggtggctttagacgatattgccgtagcaaagggtatcgatttcaatgaattgctcgatgaaatagaagcaattgtatattcgggtaccaagctgaatatcgactatttcctgaatgatgtgatggatgaagatcacatgctcgacatctatgattactttaaggaatctacgaccgacaagattgacgatgcgatggatgaattgggtgcagattacaccgaagaagaaattcgtttggttcgtatcaagtttatttcagaaatggctaactgataaggtcggtacattaataagttttgtggcagcaggcaaacggcataaaccgaaaacctgctgccacaatttttttataacttcctttttatttgtttctttttagaaaacgttcagtcagtcggcgacggagaggttcatcatacagcttcagagaagcataagccagaacgatggctcctgccagaaccaatatcatataaggaatgccttcggatatcgttgcattgttattgcatacccaggcggtgtaaatatatatcagcggatagtgagtaatgtaaatgggatacgaaatatctcccagaaacttgcagatacggctggaatacttgcctgtaaccttacctccggctcccatggaaacaataacaggaaaaataaaaatgatgcagaacgattcgtaaagcccgttcagccagtaatgttcctcacctcccaggcggggaacagataatatgacgacaataatcagggtgcaataccagaaggctcttttcttgagtcgtatcagccagccaagacgtgagagcagtaatcccccgaaaaagggaaacaagagtcgtacgaagcctacatactgctgttcccagttcagggcccatccacctaccatgtcgcccatcggtgcagtctgactgcggtagatcgtaagacaagctgctgcggcaaccagaacagccaaggcttttttactgaaccggcgtatgacaagtgcatagaggatattggcaatgtattcatagtacagcgaccatgccggaccgttcagcggatgcatttccgtccatccccgcacatcccatttcagcggaagcggtagcagcgtgcatcccagcagcatgatgagcaacaaggttcctacggaggtgtgctctatttgtggaaagcaagacgatttctggaaatagaaaagggcggctcctacgatacttcccataatgaccatcgggtgcaggcgaatgatgcgtcgtttgaagaaggttcccaatgtcatcttgttccagcggtcgtcgtaagcatagcctattacgaatcccgaaagcatgaaaaagaaatcgacggcaagatagccgtggttgatgatttgaatgagatggtttccctgagaatgtgtttcgaacaggtgaaagataataaccattagtgctgcaactccgcgaagtccgtcaagaatttcgtagtgcggtttcgaagccagataagtgctttgtgtgttcatagttgttttttcttgcgttataaaagatctttattcaacagcgcacaaagataactaacatcttattaattatgcaaaaaagaagtggctaaaatcattcttatttcttttactatctaacggctgaaaaaagataaaagatcagaggaggcagattgtagaaagtcgtggtgtgcagggcaacttttctcgatgtttttttattttttgtacaaattccaaacatttttgtacaaattattttgactgcctccgcatgtttttttgaaagctgggaaacaattagcaaataaaaaaagatgttaagcatacttcttgattggaataaaatttgtatatttgcacgcaataaaatctaaagcataaagccctatgtcatttattgcagataaagttgtaatggacggattgacttacgatgatgtattgttaatcccggcctattctgaggtattacccaaaattgtcgaactcacgacaaagttctcacgtaacattgaattaaagattccgtttgtaactgctgctatggatacagttaccgaagcacagatggctattgccattgctcgtgaaggaggtatcggtgttatccataagaacatgtctatcgaggaacaagcccgtcaggttgctattgtaaaacgtgccgaaaacggtatgatttatgatccagtaactatcaagagaggctctaccgtaaaggatgctcttgatttgatggctgaatataagattggtggtattccggtggtagatgatgaaaaatatttggtaggtattgttacaaaccgtgaccttcgttttgaaaaagatatgacaaaacgtatcgatgaagtgatgacgaaggaaaatattgtcactacagaaccgggaacagatatggaaactgcttccagaattctgcaagagaataaaattgaaaaattgccggttgttgataaagatggcaaactgattggtctgattacttataaagacattacaaaggcaaaagacaaaccgatggcttgtaaggacgccaaaggacgtttacgtgttgcagccggagtaggcgttacaaacgatacgttgcagcgtatggaagccttggtaaatgctggtgctgacgctatcgttattgatacggcacatggacattctttgtcggttatcgaaaagctgaaagaagcgaagaaagctttcccgaatattgatattgtagtcggaaatattgctacaggcgaagctgccagaacattggttgaggctggagctgatgcagtaaaagtcggtatcggtccgggttctatttgtaccacacgtgtggtagccggagttggtgttccacagttgacagccgtatacgatgttgcaaaggcactggaaggtacaggtgttcctttgattgctgatggtggcttgcgttattcaggtgatgttgtgaaagcattggctgccggaggttacagcgtgatgattggttcactggttgccggaacggaagaatcaccgggtgatactatcatcttcaacggccgtaagtttaagtcatatcgtggtatgggttcattggaagccatggaaaacggttcgaaagaccgttacttccagtcgggtacaaccgatgtgaagaaactggttccggaaggtatttctggtcgtgttccttacaaaggtacattgtatgaagtgatctaccagttggttggtggtctgcgtgccggtatgggttattgtggtgcacacaatattacagaactgcataatgccaagttcacccgtatcaccaatgccggtgtattggaaagccatccgcacgatgtagctattaccagtgaggctcctaactacagccgtccacagtaagaacggatgattcctctcacataaggatattgttttcaccacagacttctgttttcagtgtcgggatactttgtttaagttctggcgattggagtctgtggtgaatttttgttatcatgtttcactacttcttccaactctcatcgaaaatgataaggtttataacactactcttttttttctcttgtttttatctttccggcagtttgcttgcagccgaaagccctgaagtgttgttgcgtattggtggaaaagactttacgaagcaagagtttgaatattattgtaagcattacgtagcaggaaattgccgtacagaatcagtccagaatgtatttgatgatttcttgtttcaaaagctaaaatcggctgatatgaggaggacgggttgtgatacattgcctacttttcgtcagtattgcaaagtgatgcagggagaactgttgaaaaatgtcatgctggataaggaacaagaagaacatatctgtcaggatttataccgtcagagtgtagaacgactttcaaaaagcgggtgggtaaaaatagaacagattacaatacgtcttgcccaaaacgcaacgaagcaggaagaatatgcagctcgtaaccgcatggattctatttatacggcactgaagcagggaactccgtttgctgcattctcttctcagaagaaggaagatacatgggtgccggtcgtggaactgctgcaagagtttacagaccggataacttctctatcgaaaggagcgttttcggagccgtttttttctccgctgggaattcatattgtgaagctgactgataccaagccttgcatcagctatgaggaggcacggccttatcttatggcttatctggaccgtctgggggccgaacatccggcgctgaaacgagatgtctttgcccgttggaccgagggagtgcttaatgataatggagtacagatgcgtctggaaacagaagaagatgcgttgctcgcctctttttgggatcagcagcatcgggaagcatcgcctcgtgaggccacaccggaagaattggaacgttatttcaagcagaataagaatcagtatgcttgggaacttccacatttcaaaggggcggttgtccggtgtgtcaataaaaagatggcatctcgcatcaagaaatacctgaagaaacttcctgtcggtcaatggaaggaaggcctgcataaactgatggcggcagactctaccgtaaatgcttccatcgaggtaggactttttcagattggtaaaaatgcctgtgtcgatagactggccttcaagtgcggaaagctgccagaaaatgataaactcccttatgcttttttgatgggaaagaaactgaagaaaggtccagaggattataccgatgtgtacgaagtgttaagaaacgactatcgaagggagcaggaaaaaaggttgcttgcttcgctaatgcaacattttggcgtagaaattaaacaagacgttttaaaaaccgttaattgttgcggaagtaattaattaatactgtatcttcgttcactgattcagagtaataaggcgaatgagcaagtttagtatcttcattgcaggactgatagttttgtcaggatgtggcaagacggtagaccataagggaaaaactcccttggtggaggtcgaccatgaatttctgtataaggaagatctgcaagctgctatgccgatggggatgcgggggcaagatagcgtccgatttgctgaggaatatatccgcaactgggtacaagacgtgttgttgtataaaaaagcggaaggaaatattcccgataatgtaaagatcgatgaactggttgcttcgtatcgccgtgcattgattatgcatacttatcaggaagaactggtcaaccagaagctgggcagtgaaatatcggataccgaaatcgaacaatattacagtcagaataccggaatgtttcatgccaaccaaccctatattcaggggttgtttatgaaagtgccggtgggcgctcgccatttgaataatgtgcgtgcatggtataaaaaaaatacgcaggaagcgattgataagctggaaaaattcagtattggaaatgcagtgagttatgattatttttatgatcgctggattcccgtatctgctgttgcggctaagcttccgttgaaagccatcgatacggatgccgattatctaaatcgtaaccgtaacgtagaagtacgtgatacggcttattgttatttccttcatgtagaaaactttctgcctgccggacaacagttgccgttggaatatgccaagagtgaaataaaagaaatattaatcaatctgaagcgtgtggagttcataaatcgtatgaaggatgatttgtataaaaaagcttcagaggataaggacattatttattattagaacccgaacaatgaataagattaagttcatcaaggcttatgcttgtatgcttttgctgcttgccggagtgtcggcttatgcgcaaaataatgtgatagacgaagtagtctgggtcgtaggtgatgaggctattttaaagtcggacgtagagaatgaacgtctgaacgcccagtatgaaaaccggcatttcgacggcgacccgtattgtgtgattccggaagaacttgctatacagaaacttttcttgcatcaggcagaaatagatagtgtgatcgtttcggatcaggaggtaattcaggaagtggaacagcgtattgcctggcttgccgatcagatcggttcgaaagagaaaatggaggaatattataacaaatcgtatacccagattcgcgaaatgttgcgtgaaaacgtaaagagccagaaaacagtgcagcagatgcagcagaaaatcgtaggtgatatcaagctgacccctgccgaagtacgtaattatttcagcaaattgccgcaagatagtattccgtttattccgactcaggtagaggtgcagatcattactcaggagccgaaagtttcggaacaggagatagaacgtgtaaaggctcagctgcgtgagtatgccgaccgtgtgaacaagggtgaaacttcattctctacattggctcgtttctattcggaggatccgggtactgcacgacgtggtggtgaaggtggatttaccggaagaggtgagctggttcctgaatttgcgaatgtagtcttcaacttgactgatacgaaaaaagtttcgaaagtttttgaaacggagtttggttatcacattgctcagctgattgaaaaacgaggtgaccgagtaaactaccgccatattcttttgcgtccgaaagtagaccagaaagacattgatgctgcattggcacgcttggattctatagcagacgatatccgaaagaataaatttactttcgacgatgctgctacctggatttcgcaggataaggatacacgtaataatcacggattgctggccaaccctcaaaccagtacatctcgttttgaaatgcagcaattggccggtttgatatcgcaagatgtggcaaaggtcgtagagaacatgcagattggtgaaatctcgaaaccttttaccatgattaactccaaaggaaagcaagtctgcgcgattgtaaaactgaagaaccgaatcgacggacacaaggcgaccattaccgaagactatcagcgtctgaaggctatggtaacagccaaacgaagcgaggaaaaacttcagaagtggattgtcgaaaagcagaagaatacatacgtacgtattaatcccgactggagaaactgtgatttcaaatatccgggatggattaagaactgatacttaaaaccatatatgcagaaacagaaaaacaagaaaaatatatttggcgggcataggatgctgttggcaggcgtcctatgcctgttcggcttttgtttgctggcacagaaaccgatccaaaaccggaaacaaaaggttcagacggatacgacaaaggtacagaaggctccggcaactgcaccccagaaacagccggctaaaagtaaggtatatctgattcattccgatttgttgcgtaaggattcgcgtcatccggatgctcaggttgtggtgggaaatgtggttttccgtcatgatagtgtgtatatgtactgcgacagtgcatattattacgataagattagttcgttcgaggctttcagtaatgtcaagatgaatcaaggagatacactcttcttgtatggtgaccgcttgtattacgatggcaatacgcagatagccgaggtacgtatgaatgtacgtatggaaaaccgtaatactacgttgctgacagatagcttgaactacgaccgtgtatataatctgggttatttcttcgatggcggaacattgatggatgaacagaatgtcttgacctcggaatggggacaatacaatcccggtaccaaacagtcggtattcaattataacgtgaagctggtgaatccgcagtttacgttgacttccgatacgctggagtataatacggcaagcaagatagccaatattgtcggtccttcggatattttgagcgataacaatcatatatattcggaaaaaggtacctacaacaccgtgactggtaaggcatacttgctggaccgttctgttctgactaacgaaggaaaacagttgacgggagattctttattctatgaccgcaacgaaggactgggtgaggcattccgtaatatggtgttgaccgataccgtcaataaaaatatgatgacgggagaatatggttactataatgagaagaagaaatatgcatttgccaccgataaggccgtcgctgttgattactctcagggtgatagtctgttcttgcacggagatacattgctgatggaaactttccatctggatacagattcgatgtttcgtgagatgcgtgcctttcataaggtccgtttctatcggacggatgtgcaaggggtagccgattcgttggtcttttcgacaaaggatagttgcctgaccatgtatcatgatccgatattgtggaacaaaaatcagcagctggtaggtgaaaagatttgtatgtatatgaacgacagtactatcgactgggcacatatcatcaatcaggcattatcgatagagcagatagatactaccatgtataatcaggtgacgggaaaggaaatgaaagcctatttccgtaacaagcagatgtacaagacggaagttatcggttcggtacgtttggtttattatccgatggactctgatagtacgctgataggaatgaacgtgtcggaaaccagtaagctggatatttatttggaaaaccagaaactggagaagatggtgatgagtccgaaatcgaacggtacactttacccgatgacgcagattccacccggcacaagtaaattgcagaatttcgtatggttcgactatatacgtccgctgaacaagcaagatatattcaactggcgaagcaagaaggttgaagaccagttgaagaagaatgtacgcggtccggtagaattgccgaaccagcatttgtttgaaactaaaaaggagtaaaagtatgggaatgtttacgatgaggaagccacgtgcgtatcaccatgagtatatttacgtggacgaacgaaaagaaaagttggagaagatagaagagaacgcaaagcgtgatcttggcatgcttcctcctaaggaattttctcccgaagacatccggggaaagttcattgagggtactacttatctgaaacggcgtaaagagagcggacgcaagcctctgagttacgctgctatattcgttgccatagctgtacttgcatatatcttacactatctggtaacaggagaatttactttttaaactttttcatgctatgagcgatgtaatccgtttgttgcccgattccgtagccaaccagattgcggcgggcgaagtaatacagcgtccggcttctgtggttaaggagttggtagaaaatgccatcgacgccggagcacatcacatagacgttttggtgaccgatgcaggaaagacttgcattcaggtgatagacgatggaaaaggcatgtcggaaaccgatgcacgcctggctttcgaacgtcatgccacgtcgaaaatctgtcaggcttccgatttgtttgcacttcacacaatgggcttccgtggagaggcacttgcttcgattgctgcggtggctcaggtagacctgcgtacttgtcaggaaggagaacagcttggaactcatatttgtatttcgggctccaaagtagaaagtcaggaggcgatagcttgtccgcagggaagtaatttttcggtaaagaatttattcttcaatatacctgcacgacgtaagttcctgaaatcgaatcagacggagctgagtaatattctgactgaatttgagcgtatcgctttggtcaaccctgaggtttcgttcacgcttcatcacaatgatacggaaatgctgaatcttccggctatccagttgcgtcagcgtattatgggagtattcggaaagaaactgaaccaagatttgctgtcgctcgatattgaaaccagtatggtaaaaatacatggttttatcggaaagcccgaaactgcacgtaaaaaaggggcacgtcagttcttttttgccaacgggcgttacatgcggcatccgtatttccataaggctgtagtcgatgcttacgaaaacctcattccggcaggcgagcaagtgtcttacttcatttattttgatgttgatccggcaaatattgatgtgaatatccatcctacgaaaacagagataaaatttgagaacgagcagcctatctggcagattctgtcggcggcagtaaaagaaacgttaggacgcttcaatgcggtaccttccattgactttgatacggaaggtatgcctgatatcccggctttcgatgcggtgcctgcttcaggggttcgtcctccttctacatcgtacgatccttcgtataacccgtttaatgtgtcgtcggtacctccttcacagtattctccttcttcgtacaataagaagcagcatacggaatgggagccgttgtttcagggactggaaaggaaaaatacggcttcatgggatatgccttcttctcctgtaccagaggaaacatggagtgaaccagagccagagtctcagcctgcagaaccgacactttacgatgagcatccagatgtgaatgtggctgaaaaatcggcgcagcattatcaatataaaggaagttatattctgacttctgtcaagtcagggctgatgataatcgaccagcagcgtgcccatgtacgtatcttgtacgatcagtacatgaatcagatagccaaccgcaagaatgtttcgcagcgtatgctgtttcctgatatggtacatttctctccggctgaaatccctgttctggaagaaatcatggatgacctgacggcattgggctttgaactcagtaatctgggaggaggttcttatgccatcaatggggtgcctgccggtattgaaggactaaatccggaaacactggtcacaaatatggtacagactgctatcgaaaaagggtgtaaggtgaaggaagaggtacagagtatgctggctctttcgttggccaaagcagcagccattgtaccgggacaggtactgacgaatgaagaaatgaataatctggtggatgagctttttgctgttgctactcccaattatactcctgatgggaaggtcgttctttcggtattgaaagaagaagatttggaaaagcttttcaaataatagtagtacgtattcaatcgatagaaacgtcgggacgtcttagtcagaacgtgcgcatgttttatagaaaatgtgcgcacgtttttttatgctttatctcaatgtaaaaaacatatgcccttcacggcttagtgcttcgtcgaatgtgaacccttcccattcaaaacttttcagtgcttctacatcttcgatgcggtttttcagaatgaaacgtgtcatttctcctctgcacattttggcatagacaacaactgttgtgggtttaccattcttgtataccataaattcgggtgttacgacttgtaccgcttgggttacttctttccattgaaacaggtctttcatctcggcacttgctaagttgatcaagagtcccccttgtttctgtatttcagcaataaagtagtcggttaataaaggacgccagtattcaaacattgttctatttccatgttcggccaagcgtacatcgccctcaagccggtaaggctttatcaggtccagcggtctcagtaatccataaagaaaggacgtgatgaacagatgctgctgtgcatactgccagtcttcgtgagtaaagtctttcgggttgaggcgcttgaatacaatgccggtgtaagcgagtaaagccggaagggaaagactttcgggagagaggaactcatgataacgaagaacgttctcggctgccagtttattgtttatgtgcagcaggcgagccaactcttcggaactgaattgtgccatgtgcagggcattttcgtgtgcctccttttcgaaatagggagtagttgtaaagggaacctcttggcggttgcgtgcagccattgtcttggcacacgacatataaatcatcataagcagtaactgtttttgttaaatctcattacaaagatacgctctggcagggacttttgttcagaaaagacctatatttgttggtgatagaatgaattgttttatttaattttaatcgtatatgatgaaatcgttgaaaatcggtagcttggtcgtaatggctttgatgttgctctttgtgagagcgaatgcccaaaccggtgcagaaaaggtaaaaataggtgatacaatgcctcagtttacactgaattcggaagtgtatggaactgttactcctgccgacttaaagggtaaagttgttttggtaagtctgttcgctacatggtgcggaccctgccaaaaggagcttgccgaagtgcagactacactttatccgaaatataaagataatgagaatttccgtttgctggtgattggtcgtgagcatactgatgctgaactgacaaaatacaacacccgcaagaagtttactttcccgctttatccggatccgaagcgtgaagttttttcattgtttgccgaccaaagtattcctcgcgcctatttattcaataaggaaggaaaattaatatatacttctatcggatacactcccgaagaatttcagaagttgatggattcgattgaagaggctttgaaataatggattgtattgagtgagttgctatgaatgaaattgaaaaaatgagaagtgggctgcttgctgatttcacttcgcctgaaatacagagcagtttttatcattgcaagaaactcttggctaagtttcgggcaatgactctttacgatgacgattaccgtaaggtcttggaagacttggtaccgggaatacctgcaacatcggtcattcaacctccttttttctgtgatcacggacatggcatacgtatgggggagcatgtgtttgtcaatgccggatgtacgtttcttgacggggcttacattacgataggcgattataccctgattgctcccaatgttcagatttatactccacatcatcctattgattaccgagagcgtcgtgcctccaaagagtattcatatccggtaaccattggtcgggattgttggattgggggaggagcgattattcttccaggagtaacgattggcgaccgttgtattatcggggccggtagcgtggtgacgaaagatatcccttctgatagtctggcagtcggtaatccggctgtagtcaagcgtaagttgaatgttgatgataagtaatccgtccggtgaacaaacaagtcaaggttgaaaagatacatacaaaagagccttatcaaaactccatttgaaaaaagtgcaatgctggagaattgaaaaggctcttttagaatagatggcaaaatagttaagttccgaaattgatgtcaaggacgtatggaacttggctggttatatgcttttcgtatgttccttagttgttgggcaagtatatcggcttgtgtatcatccatctgcttattttttagatccgactctgtctgtaaaataaatgtttccagctctttcgcctgggggtgtgacaaatggaaataatcttcatcgccgtggaaataaagcaactttaaacgggctaacatcaattcggcttttaaggctactttccctttatatacaggagccggctggctgtcatctggagataatttaaaattcttgcttgcaatttcgatatatgaaatttgtttcccttgtctgaaatcgttgccgttgtaatcgatagaacaaatgtgatatttgttgtttataagatcgataaagtaaattctatcttttgtacattggactttatctaagttgctaaccttggaagaaacgtttaactgtcggagctcttttgcatgaagtccgttaaagtcactcttgataatcttcatatgctcatctttcatcgacagataataccagtatccgtcggcatatacagcctctgttttaatttcatcattctttggattgtatcttctcaccacacatttatcatcgtcaaatttgttgccggatgctgtatagatctctgcttttaaatttaaatgtggctgaggatgattgaatatggtatagaaccaattatcggagctgagaaaatatttgttgatgctgcccattcctgttagtttataggtgctggcatcatcaaaagtagcatcgacattataccaattaccgtcaatgtaaattctgttccacgcatgtccggaagtaccagctatggctcctgtgacataattggttgggatacctagtccattcagtaggagtgaataagaaaggctatatccctggcacacgactttgcgagtcagaaaggctcctaaagcagagaatgaactgtatgccaaataaggatattcatcgtttctttctccataaataacatccttacatagtttttgataaagcgtataggcaatttcggcagatgtcatacggtagtccaaaagtgaatagaattcttcgatacgtttctccagtaagggataaatttctggaatatgaacaggctgtatggcatattgcggcaagaaggctgataagtatgtcggattctctaaatcgactttgtagccgatatttccatttactttaagatcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgtaagatgaaacagcaacggatctttttccagaaaagcactatatagactatctgctttattggatggtatattaaattctctgacgtttatttcttgggctccttgtaagactccattggtcagcttattgaataaatccgattcattgatggggatattttctttttcgtccttattttcattcacttcatttgaatctttgtcggagtcggtcgaggtactattggtttcttctgttgtctcttctattttttcttctagtttttcttttttacatccggtcgtagataaacataaaaataatacgaatgcggttggaatcaatagtctcataaagtatggtatcgttaagtagaatgtgaaacaataactttttatctggttataacaaactcagttgcttgaatgttttgatatgtagataaaaaatccctgcttccaaattcagactgtaggacacatctgaagtttgaaagcagggaatattattttgtgaagattgatatggctatttatattcttgccagctctttatttgtatatcttcctgtttcatctggcagaaagcttcaatgaaagcttttgctagtcgggcgttggtcatcagcggaatgttatggtctattgctccgcgccggatacgataaccgtttgtcaactcacgtttggagtgatttttgggaatgttgactatcaaatcaaacttatgctcggctatcatcttcatcacattgttttcggcatgtgggcgttcgtcgggccagaatacaggtgtggtcggtatgccgtgcgaattgaggaaggtcgctgtaccggcggttgcataaatgtggtaaccgttcttactcagcatgtgactggcatccagcaagtctactttcgacttggttgctcctgaagagagcagtaccgactgtttcggaatcttatagcctgttgcaatcagtgcgttgagcagcgcttcgttgaagtcgtcgcccagacagccgacttctcctgtagacgacatgtcgactcccaaaacaggatcggcattctggaggcgggcaaacgagaactgggatgcctttacgccgatgcggtcgatgtcgaatgccgacttgtccggacgggtatatggagcgtcgagcatgatacgcgttgctgtttcgatgaagttacgtttcaaaactttagaaacaaacgggaagctgcgtgaagcacgcaaattacattctattaccttaacttcatttttacgggcaagatactgaatattgaacggaccggaaatattcagttcctgtgcaatgcggcgactgatctttttgatctggcgggctgtagagaaataaatttgttgtgccgggaatacaagtgtggcatctcccgaatgtacgccagcatattcaatgtgttcggaaatggcatattctacgatttcgccattttgggctaccgcatcgaattctatttctttggtttcttgcatgaactgagagacaactaccggatattctttcgatacttcacttgccatctgcaagaagcgggtaagttcttcttcgtcgtaacatacgttcatggcggcaccgctcaatacatacgatggacgaaccagtaccggatagcctacctttgccacaaaggctttaacatcatccagacttgtcagttcctgccatgcgggttggtcgattcctaactggtcgagcatggccgagaatttgttgcggttttcggcacggtcgatagatatgggagatgttcctaaaataggaaccgcctggcgataaagtttcatggcgaggttattcggaatttgtccgcctacggatacgatgacaccacgaggctgttccaaatcgatgacatcgagtacacgttcgaatgacagttcatcgaaatacagacggtcgcacatatcgtagtcggttgataccgtttccggattatagttaatcatgattgacttatatcccagtttgcgtgctgtctgaatagcattgacagaacaccagtcgaattctacagacgaaccaatgcgataagcacctgagccgagtacgactaccgatttctcattcttatagtaattgatgtcgtatccttcggcaccgtatgtcatgtatagatagttcgtcagttccggatgctcggaagcaaccgtattgatgcgttttacagccggaaggatacccagtttcttacggtaagcacgtaccatcagattttccttttccatgtttccacctttaggcttcagtatgaagcgggcaatctggaagtcggagaaacctaatacctttgcttcgcgcaaaacctcggcaggaagttcttccagcgaattgtacgattgcagcttggctttgtagtcgacgatgtttttcagcttgccgatgaaccacgggtctattttggtcaggtcgtagatacgttgaatatcgtatccctcttccagtgcctgagcaattgcgaagattctcaagtcggtcgggttggcaagctcatcgtccaaattatcgaagcgtgtatggtcattgcctacgaaaccatgcatgccttggccaatcatacgaagtcccttctggataatttcttcgaatgaacgtccgatggacatgatttcgccgaccgatttcatgctggagccgatacggcgtgatacaccgacaaacttggtcaggtcccagcgtggaattttgcagattaagtaatccagtgaaggagctacataagccgaatttggagtgcccatttcaccgatttcatcgagcgtatagcctaaagcgattttagcagctacgaaagccagcggataacccgtagctttggatgccaaagcagaggaacggctaaggcgtgcatttacttcaatgatacgatagtcgttcgaatcggcattaaaggcatattgtatgttacattctcccacgatgcctaaatggcggatacattgtttcgataattcctggagcatgacaacctgatcctgagtcagagaacaagttggggctaccacaatcgattcacccgtatgaatgcctagcggatcgaaattttccatgctggcaaccgtaaagcaatgatcgtttgcatcgcggattacttcaaattctatttctttccatcccttgagcgattcttctaccagtatctgcggagagaaggtaaaagcgctttcagccagttcaatgaatttttcctcgttgggacagataccacttcccagtccgccaagagcatatgccgaacggatcatgaccggatagccgatgcggcgtgcagcagtcagggcatccgacatgttttctactgcctggctgatgggtgttttcagttcgatttcattcaacttcttgacaaataggtcacggtcttcggtgtacattatggcttcgaccgacgttcccagaacttttacaccatattccttcagcactccagtctggtataattctgtaccgcagttcagggcagtctgtcctccaaatgccagtaagataccgtctggacgttctttcttgatgatttcggttacaaaataaggagtaaccggcaggaaatatactcggtcggcaataccttccgatgtttggatagtagcgatattaggatttactaatacagaactgataccttcttcacgcaaggctttcagagcctgtgagcctgaataatcgaattctccggcttgaccgattttaagtgcgcctgagccaagcaccaggactttcttcaattctttcttcatggtgttttattaattagatttatggttgtcgttcatagtcttatacatgcaaagaaacaattaattttgaagaaaacaaaggatttgcttatctttgctgctaattaataaatctcaaagatataatgatgaaaaaggaaaaaattatacttaccggcgatcgtccaaccgggaaactgcatatcggacattatgttggttcgctgcgtcgtcgtgtggaacttcagaactcaggactttacgataaaatctttgttttcgaggccgatggacaggctttgaccgacaatatagataatccggaaaaagttcgtcagaacgtgattgaggtggctctcgattatctggctgccggactagaccctgcgaaatctacaatcttcatccagtcgcagataccggaactttatgagttgagcttttatttcatggacttggtaacggtttctcgtttgcagcgtaatcctacggtaaagacagagattcagatgcgtaactttgaagcaagtattcctgtaggattctttacttatcctatcagccaggctgccgatattgctgctttcaaggctacgacagttccggtgggggaagatcaggaaccgatgattgagcagaccagagagattgttcgtcgtttcaattatatttatggtgaaacgctggttgaaccggaaattcttttgccggacaatgccgcttgtatgcgtctgccgggtaccgatggtaaggccaagatgagtaagtcgctgggtaactgtatctatctggccgattcggctgatgaagttgaaaagaaggtaaagagcatgtatactgacccgactcatattaaggtcagcgatccgggtaagttggaaggaaactgtgtcttcacgtacttggatgctttctgtcgtccggaacatttcgaacgttatttgcccgactatgcaagtctggatgagttgaaggctcactatactcgtggtggactgggagatatgaaggtgaagaaattcctggcagccattatgcaggaagaacttgcaccgatacgtgaccgtcgtaaaatgttcgaaaaagatattccggcagtatacgatatgctgaagaaaggttgtgaagtagctcgtgaaacagccgcacagaccatggatgaagtacgtcgtgccatgaaaatcaattactttgatgatgctgcactgatagctgaacaggcaaagcgttttgcacaagaataacgttcagattttacgataagcataattaagataaatcgctattcggataaatacaagtaccttgtatttgccggatagcgatttttgtttgtatcagtgaacaaaaaaggaaaatgggctgttccttattatatatgattatttgtttatcttaaaaaatggtacttatgaaaaagattgcgttaagttgcatacttatgtttctttctttgagcttcgccttggctcaggaaaattcctatcagttgtcaagccatattttggatattactcagggaaagcccgctcctaatgtgaagataagtctgtataaacagcaggctgacgggaaatggaaaatgatagaagagaaactcaccgatgaaaacggtcgtgtcaaggatttcttgaaggaagatggtacagagcacgatggcgtgtataaacttatttatcacgtgaaaacttattttgacctgatgggagaggatacattttatccttttgtcgaggttgccttcgaaataaaggggaaaaaacattatcatgtgcctatcactttatcaccttacggttattctacctaccgagggaactgatttatagagtcggttgcagaggtttggaaggtgaaaaatgtacttttttgctggcttcacgatggtttttgtgaaaaaaacagagcaaatatttgcatattcaaaataaagccgtacctttgcaaccgcaattgagaacgagagctaagggcgtttagctcagctggttcagagcatctgccttacaagcagagggtcggcggttcgaatccgtcaacgcccaccactaaacctactcttgttcttcaattcgcttttggggcgtttagctcagctggttcagagcatctgccttacaagcagagggtcggcggttcgaatccgtcaacgcccacttcccaaaagcataaatggtcaaattttccccctttggggcgtttagctcagctggttcagagcatctgccttacaagcagagggtcggcggttcgaatccgtcaacgcccacaaatgagaacttaattttagtgtttttcggacgtttagctcagctggttcagagcatctgccttacaagcagagggtcggcggttcgaatccgtcaacgtccacttcaagagtttcatccgttccggtggaactctttttttatgttctttctgttgaacctttttttcgaggttgttgttctatcgataatagcataagtttatgaagtctttgattctggcggacaatcaggttgcaacacggttgggaataaaatttctggctgtagaaagtggtaaacctgcttccttgataaaggaagcggaaaacctgcatgacttgtcggcagaattatctgattgtccggatgcagtcgtggttattgattatactttgttcgattgcactgccgatcagctttgggtgttgaaagagtgttttccagaatctgtctttatcctttttagcgaagcgctgagtgaagattttgtgcggaggatgatattgggctcggtaggcttcagcctgttgttgaaagactctgatctgtcggaactgcttgcctgtatgcagagtgcggagcagggagagcagtttgtctgtgcgaaggttaaaggctggctgtatagtggcgagcagcatgtgtcagccggcattcctcagctgacagctactgaaaaggagatactccgttcgcttgcgttgggtaagagtaccaaagagattgcagccgaacgcttcctgagtgtatataccatcatgacgcatcgcaaaaatattttccgaaaactgaatgtaaacaatgcgcaggaagctatccgatatgctttgcgggcaggaatagtcaatgttgcagaatattgcatctgatgccggtcggaaagcgatagtatgtttctttgtaaaatcgtcttatagtatagatatacaaatccccctgtgtcatccttggtttatttgtggtaaggatgaaacagagggattttttgtttaaagcttcagactataaaatttttaattctcggatgttatgttgaagaattcggggttcgtgacgaataaatcaattatatcttgtcgagtgcctggctcaggtcggcaatcaaatcgtctacatgctctgttccgatagacaggcggacggttcccggcttgatgtgctgctcttccagctctttttcattcagctgcgaatgggttgtggtagcaggatgaataaccagcgatttcatgtcggccacattggccagcagtgagaatatctgtaaactgtctatgaagcgttgggcttccttaattcctcccttaatgtcgattgtaaagatggaacctcctccttgcgggaaataacgctcgtaaaggagatggtcgggatgatcgggcagcgacgggtgatgtacggcttccactttaggatgcttgcttaagaaatccacaattttcaatgcgttggctacgtggcgttctacacggagtgaaagcgtttccagtccctgaagtagcagaaaagcgttgaaaggactgatggcagctccggtatcgcgcaataaaatagcacggattcggatgatgtaggcggcagctcccgctgcgtcggtaaaccgtatgccgtgatagcaagggtccggttcggtcaattgtggaaatttacccgaggctttccagtcgaatttacccgagtcgataatgacgcctccaaggcttgtaccgtgtcctccgatgaatttggttgccgaatgtaccacaatgtcagctccatgctctatcggtcgaatcagatagggtgtaccgaatgtgttgtctatcaccagtggaatctgatgggcatgagcaattcgtgcaacggcttcaatgtctgtaatgttcgaattcgggtttcccaacgtttcgatgaagatgagcttggtattttcctgcaaagcttcctcgaagttttcgattcgactcggatcgacaaaagtcgtagttaaccccgaagcgggaagcgtgtgagccagtaagttgtacgttcccccgtagatggtattggcagctacgatatggtcgcccgcgcgggtgatgttctggaacgcatacgtaatggcagcggctcccgatgcaacggcgagagcggcaatacctccctccagtgctgccatgcgtttttcgaatacatcttgtgtcgggttggatagtcgaccgtagatatttcccggatcttgcagggcaaaacgtgccgtagcatgggccgaattgtgaaagacatacgatgttgtctggtagataggtacggcacgtgcatcggtggtggggtctgcctgttcttgtcctacgtgtagctgaagggtttcgaagtgaagtttttgaaagttcatagttgtaatgattttgtatgttggttgattttgtgatttaaagagggtattcttcgaaggcataaagtacggtcgacagataacgttctccggtgtcgggtagtagcacgacgatgtttttgccttcatattcgggcatttgtgccagttgcagtgcggcatatgtcgcagctcccgatgaaatgcccaccagtaatccttcctgtaaggacagttccctgccggtacggatggcatcatcgtcttttacgcgtacaatcttgtctactacatccgggttatatgttttcgggacgaaaccggctcctataccttgaattttgtgcatacccggtttgtcgcccgacagaactgccgacgtatcaggttctaccgctacaatttcaatctgcggattgtacgatttcagtccttcacctactccgcttagcgttcctcctgtgcctactccggcaatgaatacgtccactttgccgtcagtgtcttgccagatttctttggcggtggtcaggatgtgagctcggggattagctggattttcgaattgttgcagaataacggctcccggaatctggtcgcggagttcttcggcctttttgatggctccgctcatgccttccttgccgggggtaagcaccagttgtgctcccatggctttcagcaggttctggcgttccagactcatggtttcgggcatggtaagaatcgctttgtatccttttactgatgctacccatgccagtcctacgccggtgtttccactggttggttcaataattactgctccgggctgtaagatacctttctgctcggcatcttctatcattgccagtgcgatgcggtctttgacgcttcctccgggattaaagaattctagtttggcgataatgcgtgcttttgcctcataagttttacttaaatgctccagttccagcagaggagtatttccgattagttcggtgaggcttttgtgaatttttgccataagcgttcgattttagttgcttcactggcaaaattaacggattgcaggaggaatagcaataccccatttagggtatattgaagaaaaaacaataaaaaaagagaagcattggcttctcttgtctagttgcggaggcctgactcgaacagacgacctttgggttatgagcccaacgagctaccaactgctccactccgcgatgttatttcttgtttgtttgaggttgatacctcttgtctagttgcggaggcctgactcgaacagacgacctttgggttatgagcccaacgagctaccaactgctccactccgcgatgttatttcttgtttgtttgaggttgatacctcttgtctagttgcggaggcctgactcgaacagacgacctttgggttatgagcccaacgagctaccaactgctccactccgcgatgttatttcttaattgcggtgcaaaggtaaggactttattttaaaaagacaaattatttagtgaaatatttgactatttttgcatttttctgctaaaaatatacagaaatacgcgtagattttatttttaggcggtatttatgtcaaaaaaaatcattaaatagccgtttctcctcggaagttaatagtggtaaaaagaagaatttttgaacaaggtcctgtctgaatatactgcgaggtagtaggaaggcagggcagatgtgatgcggtttttgtacaaattttcggattttttgtacaaaaaatccgaaaatgtcagcacgttttccttcatttatgcagagattgttcctgatatttcttattgattgagtgacagttgtttatctgtttgcggttagaaagacgtcggatgtgaagaaatattcgtgttacgacttgagtattattgttgttttttcataaactcttcatcttcgtgatggaaaatatatcttggatttgtgtagataaaagaaaaacagtaattttgctcacaatatacatgattgtgcaataggagagttagaatgactgtactgaagaccagagctaaattagtggatgttgcccggcagttgtttgccaagaaaggtgtagaagctacgacaatgaacgacattgccctggcttctaagaaagggcgccgtacgctatatacttattttaagaataaggatcagatttacatggccgtagtggagtctgaactcaaaatgctttcggatacgatggataaggttgcccggaaaccgatcgttccggataagaaaatcctggagctgattatgactcatctggatatcataaagatggccgtttaccgtaatggtacgctccgtgccgattttttccgtgacatctggcgtgtggaagctatgaggaaatacttcgacaacaatgagattaagttgtttcgtgaggttttgaaggaaggaaaagatcaggggctcttcgatatcgataacgtggagataacggcagatatcttgcattattgcattaaaggaattgaagttccgtacattcgcggtcagataggtgaagaccttgacgatgaaacgggctggcgatatgtgtcgaaaatcgtatatggggcattaggttgccggaaagagaaataagtttaatcttttaaatataaaaaaacatgggattattaacaggaaaaacagctattgtaactggtgctgctcgtggtatcggtaaggctatcgcaatgaaatttgcttcagaaggtgcaaatattgcgttcacagacttggttattgatgaaaacggaaagaatacagaagctgaaatcgctgcattgggcgtaaaggtaaaaggttatgcttcgaatgctgccagctttgaagatacagcaaaggttgtagaacagatcaaggaagatttcggtacaatcgatatcttggtaaacaatgccggaattacaaaggatggcttgatgatgcgtatgagcgaaggacagtgggatgctgttatcaacgtcaacctgaagtcagctttcaacttcattcatgcctgcactcctatcatgatgcgtcagaagagtggtaatattatcaacatggcttctgtagtaggtgtacacggaaacgctggtcagtgcaactattctgcttcaaaggcaggtctgattggtctggctaagtcaattgctcaggaattgggttctcgtggtatccgtgcaaacgctatcgctccgggcttcatcattacagatatgactgctaagttgaccgacgaagtgaaggctgaatggacaaagaagattcctttgcgtcgtggcggtactccggaagatgtggcaaatatcgctttgttcttggcttctgacttgtcttcttatgtatcaggacaggttatccaggtagatggtggtatgaatatgtaatagaataagtagtaaataattgaggatgaaggatggggaatcttcgtgccggcatgtgatgtcgcacagttcttcattcttcatctttttatttcagggtattatgaccgtagtatacgaagataaccatattataatagtcaataaaacggcttccgaaattgtgcagggtgataagacgggagatgttccactgtctgaaaccgtgaaacaatatatcaaggagaaatatgcaaagcccggtaacgtatttctgggggtgacgcaccgtctggatcgtccggtaagcggactggttgtatttgcaaagaccagcaaggcattgagccgtctgaacgatatgttccgcaacagtgaggtgaagaaaacctactgggccattgtaaagcaatgtcctcctgccgaagaaggggaactggttcactatctggtgcgtaatgaaaaacagaacaaatcgtatgcttacgacaaggaggtgaaaaactccaagaaggctattctcgattataagctgataggacattcacagaattattatttgctggagataaacttaaaaacaggacgtcatcatcagattcgttgccagttggccaagatgggttgtcccatcaagggtgatttgaaatatggctttccccgttccaatccggacggaagtatttgtctgcatgcacgtcggattcgtttcattcatccggtttcgaaagagctgattgatgttacggcacctgttccttcaggtaatttatggaatggattcgacatgaatctataaaaagaaaaacggaagcgcttcacagcgtctccgttcattaaaaaacacataggcatcttcattttcttaaaggttacgtttcagggggaagaaacgtacctttctctcttttgtttttatggggttgggtttttgtagtttagtttttgccttttatgttgttatagggtgtgtgtttatcaattctctctattatatagtgcaattggcgtgccaaactttacctgttctgtaaatgcttgattcccttttatttgctggaatgttcttttagaaaataatgtggaaagtgtggaatgattggggagtgttgtggaattattccacacttttcggaatgtgttttcatgtgtcgatagttatcggggagaaattatcctatattatacagtttcattttattgtataatgtcttgcggtcgataccgagcagaagtgcagctttcgtcttattgtttccagtctgctgcaatgcattcaggatacgctgcttctccatttcttcgtcgtgcagaacaaaggatgaagtctgaggggtacttgcaggttgcgataaaatctcgtcacccagatcgtgtaacgtaataaactctccccgtgccagtagggtagcacgtttcacgatattcttcaactggcggagattacccggccatgaatagcgttggagggcttcactggctgcggcatcgaagccaatgaggtcgcgttccagttcgcagttggcttggtccagaaagaagtttgcaaagagcagaatgtcttcggggcgttctttcaagtcgggcatacgcaaggtaaattcattgatgcggtgatacagatcttctcggaagttacctttggttattgcttcctgcagattttcattggtagcacttatcagtcgtacgtcgacttctatttccttggtggaaccgatccggcggatccggcgttcctgtaaggcacgtaacagttgtacctgcacttcgtagctcagatttcctatttcatcgagaaacaatgttcctccgtttgcttcttcgaaagctccgactttgtcgttcagtgcccctgtaaatgaaccttttatatgcccgaaaaattcggaagctgccaaatccttaggaatagatccgcagtctatggcgataaaaggcttcccgtttcgcttgcttagttcatggattcggtgggctacgtattcctttcccgtaccgctggctccgtttatcaggacagacatctgggtaggagctaccagcctcacgtagctgaaaagctgatgtgcagcttcactttctccttccaaaaagctttgtggtgctgtttttcccagttgtacgtcggtagttgttacctcttgttccggcttttgtatagcttcccttatttttttcaacagttcgtcaggctgtaccggcttggcaatgtaatcgcttgctccttgtttgatagcctgtacggcagtttggatttccgcatagcttgtcatgatgataaaaggagtggtgcacgattggctgcggagccatgcaagcaagtgaattccgtcttggtcgggcaaacgcaagtcggacagaataaggtcataagaacgtgccgagagttgtttcttggcgcgtgaactgctacttgccgtatcaacttcgaatccttttttccccagccatgttttgagcatggtagaaaaagtcaaatcatcttcgattattagaatagacggaatcatatatttctttttatccgatgtatttattattcatagccttgcttttccggttactctctgtcggtcgatagatcaaagagtaccctgtttcaccgtgagaaagtcttattcttttatagaatatttgtgatgcgattttggaaatttaattccattctacagtcaaatgttcaggtatatcaaggcaatatttatacaaagatagtgttttttcgctattgtatttagagcttgttctaatttttcgaaaagtaaacccgaacaagcttctttttaagttttctttggaacatgctgctccgttgtctatgcttggagaatattaccggttaccttgcgtgcctgctctatgacatcggcaatgcaagtcagagcaatctctgcttgtgcctttgcttcctcagtcagaaccgtttttcctctatgaaattccagccattgcaatgccggcacagcctttttagcttcaatcatggtaaaggtaggaagcattttatgagctacagcacataaatcctccatatctccagcttccaatgcctgtttcatccgttcgtaatttttggaactttctccgatgaaggtttccagaatttcgtgcgctgcttccggatcatctcccgagaaggctgtcagcggtgaaaagttatacgcattgtctgttggtacgagtgtgggcttatgctcttcctgtggcggtatttctttccagtctgccgatgtatgtgccttgaatatcctcagtaattcatcttgattgaatggcttgtgtaggcatccggcaaagcctttggcttggaaatcagcttcatccatgtcgcttcgtgccgtaatggctatgacgggaatcgtctttgcttgcggaacgtcgagacttctcagtttctggagcagttcgaatccgttcattgccggcatttgtatatcggtaagaatgatatcgaacggttcggaagcaaccaggttgaaaagttcttccggctgttcacaactttttatcactggaggtatgttgtggttcgcatgattgaacaggtcgtaaatcatgacttctgtcagattcagttggatgcggtcatcgtctatcagcagaagccgccattgctttttatcgtccggtaatgtttcttcgtgggtaactggtgccttggttactctaggaagatacagttctacttggaaagtggtgccttgtctcggagtgctttctaccgaaatttctcctttcagcagttcaaccagtttcttggtgatggatagccccagcccgaaaccttcttgtccctgggcactttgtagccgtgtaaacgcttggaatatacgttgctgttcttgtggattcattccgcatcccgtatcttttacgatgaaggtaaaccggttttgtccataatcaacttctatcgtaatgttgccttgtgaagtaaatttcaaggcattcgatatcaggttctctgcaatctggcggatacggaacggatctccttccagattgagtgtaggaggtatatgttcttttagctcaagtgccagtcctttcttttcagctccgggtaagaaactggtatagatgctttcgaacagttcgtgcggattgaaggttaccggatgaatatccatctttccggcttctagtcggtgatagtcgagcagcgaagtgaccagatccagcagatgatgtgccgaacttcgcatgttatgcaggtagaactgctggcgtttgtcgtgtaccagtctgattaataaatcaatatatcctataatagatccagccggtgccttgatgtcgtgcgtaatggtcagcatcagtttctcgcgggcaacgagcaggttttcggcatagagcttggctttttccagctccttccggtaatggttgctgcgggtaatatcgcaccagatgatggtaaagaagatcagtaccagcaagactgcaagaatggcgatggttgccatggtccatgctgcctgctggcgaatgctctgttcgtgtgcaaagcggatttccatagccttttgttcgtcgtcctcgattgtttccagcaactggtttacgcgctggctgactcttcctcctgcgatacgcagctggctgatacgggcgtcgagtgtccgctgactttcctgtcttgtctggaagaccttgtgctgtatggaagtcagcatggtggcgatggtgtctaccgggttgtaagcttcgtctatcgtatcggtatattcttcctgtataatattgtctacctgtgtagaatcgggtttgccgggagaaaataagtcggccaaacgacggaagaacttcttgggtttgtgatggatagtatacgaattatgatgcgtaacgacccgtcggcgtacatgcgtgctgttcaagatagaatcctgctgcatgatcagactgtccagttgctgacggtacagctcatctgtcgggctttgccgcatggcttcgaggaccagaatcatgttttgttccttattgcgtaataaagagcgtaccgtatccagacgtaactgttgcagagtatccgtcagcagctgctgaagcgagtcgatcagtacgcttgtttccttcatggcctttttatacttcggatactcgttcaggcgtccggtacgcaaggtctgtccgatgatttcggcttcgtacagttgcgtcacgatctggtgcgtggttttccttcggttactgatagtttcttccagccccgtaggagtagtaagcagcgtcatttgctgatagatatacccgatggcgccgaaaagcagacagataagcaggatatatccaaaggcgattttggtagaagtggaaaacatagtcaggctcctttccctgttttatacctgaacctgagataatacatgatgccggcactggtcagtccgaacgggaaagccatccatataccggtaattccccagttgcagacaaagccgaacaggtatcccaagggcagtgatatgataaaataagcgataaacgaaaacagcatcatcagacgtacatcggcgatgcccctcagtgagttggcaaagttgatttgcaatccgtcgccaaactggtagagcaggaacgggataatgacctgtgctaccatggcagctacggtcgcgtcgtcggtaaaccagcctcccaaatgattacgcagcagataaatagggatggatgtacagacaatcatgatcaggatgatatggaaacccacgtttgccgtgcgccttacgttctccatatctctctgtccgaggaagttgctgatacggactgatatagctgctcccatgccataatacatcatgaagcagatttgtgacacggcaatcataatctgataactggcaagttccgcgcttcccaaccaacccaccataatagcactcaggctgaaagaggctgtttccattcccatctgtgcggcaatgggccatcccagtctgttcaggcgactgaaatcggccttgttgaggctgccccgacggaagccttcccggaaagactggtagcggcgggtaccgaaaaataagactaaataagctatcaccatgagaatgcgcgataccagcgtggaaacgccggcacccagtaagcccagttccggcatgccgagctttccgtaaataagaatatagttgccgatgatattcagaatattgccgctcagcagtatccacatcgacactttggtatcggttataccgtcggaaaactgtttgaatccgttgaaccacagcacgaaaggtagggaaaccagcagaaccatgaagtaaggtcgcatgtgcggtatcagctcggcgggttgtcccatccggtccagattcacgtaaagtatggtcattaccagacatacgatggctgccagtacggtattggctgccaggctgttcttgagaatccttcccacatctccgattttatgctgaccgaacaggctgcctactacgggagtcagtccataggcaaagcctgtactgaagataatggcaaggttgaacatgttgttcacgaagctggcagccgccagttccgtcgtgctgtgatgaccaatcatcagtgtgtcggcaaatcccagtacgatgactcctatctgtccgatgacgatagggagccccagtgacaacaatgctcggtaatgtgactgactcatttgattgctttataatataggatgttacagttctcgggaacaaaggcacgccgtgccgtttcttgtatctgttctaccgtaaccgaacggtatttcccgacttccagattgatatcttccgcacgtcccagcaactcgaagaatgccagatttgtcgccacgttcaggtaattgatgttattgaaaatttgttcgctttcataacggttcttcactttttccagttcttgttcggatacgggaaccgttttcaatttgtcgagttcctgccatacagcttcttctgcctgttccagtgtgacgcccgatgccggtttgcccgtaatgtgcaataacccttcgtcgaggctgcccgaaatataggcatcgatggaggtgaacagtttcttctcctgtaccagcgtctggataaagcgtgatgaacgtccgttcgacagcagatcggtgatgatgtcgaatgcatgataggcacgatgatagcgattgcacatgtggaaagccatgtacaaagcgtctaccggcactttgcgttccacgctgcgtcggcgtatggcagtctgaggcttttctgccggcaactggcgcttgggaatctcacgtgccggtatcgggccaaaccatttttctgccagacgaacagtttcgtcgaaggaaatatgtccggtgacggcgagaattgcattgttcggggcataaaaccggtagaagaagcttttcacctcttccagcgtggcgttagctatatgactgatctcctttccgatagtcggccaacggtacggatggttttggtaagccatttcgcgcaataagtgtgctgcgtcgccgtaaggttggttcaggttgcgttgcttgaattcttcgatgactacctgacgctgtacttccaagctttgcggactgaagtcgaggcttagcatacggtcactctccagccagaaacctgtttctacgttctggtagggaagggtaatgtaataattggtaatatcgttgttggtccaggcgttattctcgccgccggcgttttgtaccggaacatcatagtcgggaatattcaccgaaccgccgaacatcagatgttcgaacagatgggcaaaaccggtatgttccggatcttcgtcgcgggctcctacgtcgtacaacacattgagggcaaccatttgagtagagttgtcctcattgtgtacgatacgcagtccgttggacagtgtatgatggtttacttgtatcattattctttatccgatttctctatgacagaagctttcagtatacgtacatccttttccggacggtctgtacgattggtttttactgcttcgatacgtgctaccacgtccataccgtctactacttctccaaatatcgtatagctgccgtccaagtggggagctccacctactgtggtataagcttctatctgttcgcgggtaaacttcagggcaggttctttctttacttcggcacgtgcctgtgcttcaaggctgtcttgcagtgccatcagaccttccatgtcgtttgccttacgcattttgtagatttccttcatatgcttgcgtgccagtgtctggaataccgtgtcgagtcttgcttcgttcaactggttttccatgttaatcatctgagcttcggagaactttctaccggttacgatatagaactggcagcccgatgattctctgttgggattgacatcatcgccctgacgtgcggcggcaagtacacctcttttatggaaaaatttcggattgatttctgccggaatggtgtaaccaacatcaccggtacctaaagtagtggttgtatcggtagcagttttactctgcgggtcgcctgcctgaatcatgaaattcttgatgacacggtggaaaagtgtgctgtcgtataccccttctttcaccagcttgatgaaattgtcgcggtgtttcggcgtttcatcatacaactttacggtaatatttcccatcgtcgtttccaagcgtacaagtgtttcgtttcctgttatcatagaattttcttttttttgacttccggtgcatgcggtcatgcagcagagaatcagggtgaataaaatgattgttttcttcatacgaggtgtgttttgcttgcaaatgtacaaaaacccgtgggaatataaaaaagatgtcagcacgtatgagagaaaacatgctgacatctttttattttttgtacaaaataattttgtttttgtacaaattatcttgaaatgtcttgtagacttgcggttaatgccttattctgccagactaagtatctgcgcttcctgaggaacataatctccctggaagaagcggctggcacgaagcaggtgacgccagatgctgaccaactcctgtgtttcctgaaggatgttcaggtacaccatcgaagctttcagacttgcattgtcggtttcctgcatgcggttcatctgctgcttgcgcagagctgatatcttattcttcagggcatcaccttttaccagaatatcgtctgcttcacgatagtcgttgttttcgatagctgtacgggtacgttccatcagctgacagagttcttcacgtatcggaaggaattctgcgatgcagtctttcgatatcggattgaagttgttgtctacatgttccttacaaggttcacagatacgcttcaagcagtaaagcatctgttcgcagctgttgctgcctaggtggaaccaggtattcttttcgatagctattggaataggaatacgacgcaatcctaaaatttctttacgacgacgctttttcaacatcttcttttgctcgtcggtagaattcatcactttttttagctgtttcaggtcctcgttgatgaaaccgtcggtaacttgcatgtaagcttgttcggtataagcgatgtaatctgtcagggtaccttttacatgctggcggagcagtgacagcacttccgatttgtctttgctggccatcatgcgtttaaagatatcatcctgctgttctgccttttctttcttgctgtacttgatgttgctgcggatcagcaggaatacagccacacagataaagatgaacatgcccacaaagcttgtgtagaacatgatggcagttaccagtgcacagatggtaaaggctacgaaagcggtgatgaaccatccgccgatgaccgacaacattccggtgatacggtatacggcactttcacgtccccaagcacggtcggcaagtgaagaacccattgccacgatgaaagttacgtatgtagtagagagcgggagcttcatggttgtaccgatgataatcagcaaaccggaaagtaccaaattgacagatgcacgaaccatatcgaatgcggctccgtttgccagaatcacttcatctttgttgaaacggctgtctatccagcggcgcatgcctgccggaatcaccttaaccagaaattcgttgatagctgtcgcacggcggacgatggtacgtgccaatgccgacgaaccgaacatttcgtcaccctcttcctgacgagccagatcgacagatgtcttgattacattctttgctttcttagaagtagccagcgcataaaccatgatgatacccgaagccagcaggaagatagccggagtcttagccgacgacatcagcgaattcatcataaagtcgtgtatgcctacaccgttcgagttggctgcataatccgtataagccgagaaaccagccaaaggcacaccgataaagttgacaaggtcgtttccggcaaatgcgagtgccagtgagaaagtacccagcaacacgatgatacggaatacatttaccttgcaccagtgcaggatttgcatcagtacggtaaagaaaacaaagcaagctacaactagcatagttgtgttttcatctatccacgcaagtgattctgcactcataaacggtgcgcttttcaatccctttatcagcacgaaataggcaagtgcggtcacagaaataccaccaaatacgccaatggtccaggaaagatgttttttgtagttgaagctgaagataagacgagagatgtattgaacgattgttccggcaatgaaggcgatggcaacggagaggaaaatacccataataacggataaggctttttcggtattcatcatgtctcctaaagacagaagaccagtttcatcgccgatgattttgagaattgcaagaataaatgtacctcccaataattcgaagaccattgatacggtagtcgaggtagggagtccgagagtgttgaatacgtccagcagcaccacatccgttaccataacggcaagcagaatacacataatttcatagaaactgaaattggctggttggaaaataccatgtcgggcgatgtccatcatgccgttactcataattgcacctacgaatacgccgactgccgctacaatgacgatggttttataccgggcaacctttgctcctacggcggaattcatgaagttaactgcatcgttgctgacacctactagcaggtcgaatattgccagcatgaaaaggaaaatgacaattcctaaataaagagtttccatattttactataaaaatgattttttagcgtcgcaaagttatggaaaatctgtcagacgcctgttgttatacgtattacatttctgttacaaaatacttaggggctatgttataagggtaaaatgttttttttagaatttcttcgcatgtttatctattggaaattcgtaactttgtgccctaaatcatagaattatatagtaattactaaaatattaaagcaatgtcagagtcaaagagaataaaaacggccttggtatcggtatatcacaaggacggtttggatgcgatcattcgtcgtttggcggaagaaggtgtagaatttttgtcgacaggcggtacacgtcattttattgaaagcttaggatatgcttgtcatgcagtagaagatctgactggatatccttctattctgggcggtcgtgtcaagacacttcacccgaaagtattcggtggtattttgtgccgtcgtgaactggaagaggaccgtcagcaggttaccaaatatgaaattcctgaaatagacctggtgattgtcgacctttatccgtttgaagacaccgttgcttcgggagccgatgctcagtctatcatcgaaaagattgatataggtggtatctcgttgattcgtgctgctgcaaagaacttcaatgatgtagttatcgtggcaagcaaggctcagtataagcctttcctcgacatcattacagaaaaaggtgcagtgactactcgtgaagaacgtcgctggttcgccaaagaagcgtttgccgtatcttctcattacgactcggctatcttcggatggttcgacggaaacgataattctgctttccgttatgcagctgaacagccgaaggcattgcgttatggtgagaatcctcatcaaaaaggtattttcttcggtgacttcgatcagatgttcgaacagattcatggtaaggaaatctcttataacaatttgcttgacatcaatgcggctgtcgatctgattgatgagttcaagggtgaaacgactttcgctatcttgaagcacaacaatgcttgcggtctggcttctcgtccggtattggtagatgcttggcgtgctgctttggcaggtgatccggtttctgcctttggtggtgtgctggtaacaaatgccgtagtcgaccgtgctacagccgaagaaatcaacaacttgttcttcgaagtaatcatcgctccgggctacgatgcagatgcgctggagattcttactcagaagaagaaccgtatcattctggtgcgcaaagaagctgaaactccgaaaaagcagttccgctctttgctgaacggtgtgctggttcaggaccgcgacctgaaggttgaaactcgtgaagacttgaagcaggtttccgaaaaggctccttcggatgcagaaatcgaagatctgcttttcgccaataagattgtaaagcagagcaagagcaatgctatcgtgctggctaaaggtaaacaattggttgccagtggtgtaggacagacttcacgtgtagatgctttgaaacaggctatcgaaaaggctaaatcgttcggattcgacctgaacggagctgtaatggctagtgatgctttcttccccttccccgattgtgtggaacttgccgacaaggaaggtatcaaggctgttatccagccgggtggttcggtaaaggacgatttgacattccagtactgcaatgcacacggtgtagctatggtggtgactggtgtacgtcattttaaacactaatataactcgaataataataatgaataaagagtgattcttcgttcattattttaaaaagattcttcaataggaaaattatgggattattctcttttacacaagaaatagcaatggatcttggaactgccaataccattatattgagcaacgacaagattgtggtagatgaaccttcagtggtagcactcgaccgccgtaccgacaagatgattgccgtaggtgagcgtgcgaagctgatgtatgaaaaggaaaacccaaacatccgtacggtccgcccgctgcgtgacggtgtgattgccgatttcaatgcgtgcgaacagatgatgcgtggtttgattaagaaggtaaatacgggacgccgcttgtttactccctcactgcgtatggttatcggagttccttctggttctaccgaggtagaactgagagcggttcgcgatagtgccgaacatgcaggcggacgtgatgtctatctgatttttgaaccgatggctgctgctatcggtatcggactggatgtggaagctcccgaaggtaacatgattgtggatataggtggtggttctactgaaattgctgtcatttcattgggaggtatcgtttcgaataactctatccgtattgccggagatgacttgactgccgatattcaggaatatatgagccgtcagcataatgtaaaggtcagcgaacgtatggctgagcgtatcaaaattcatgtaggtgctgctctgaccgatctgggtgatgaagctccggaagattatatcgtgcgcggaccgaaccgtattacggcactgccgatggaagttccggtttgctatcaggaaatcgctcactgtctggaaaaaagcattgcaaagattgaaacggctatcttgagtgcgctggaaaatacaccgcccgaattgtatgccgatatcgtaagcaatggtatttatctggcaggtggaggcgcgctgctgcgtggactcgacaaacgtctgaccgacaagattaatattccgttccatattgccgaagaccctctgttgagtgttgccaaaggaacaggtattgccttgaagaatgtcgaccgtttctcattcttgatgagataaaatagtttcctgccttgaggcatggatgaaaattgcggggccttttgtgagaatggctccgcattaatcttgatatttttcttctctgaagttgtaggtatgcgaaatctgctgaactttttattgaaatatgattattggctgctcttcgttttgctggaggtagtgagcttcattctgctgttccgtttcaacagctatcagggaagtgtcttttttacttcagccaaccgtgttgcaggaagtatttatgaggtggcaaacgaaatcacatcttattttgggctgcatacggtaaaccgtgatctggtgcgtcgtaatgtagagctggaattgcaggtggaatccttgaacagagcgcttaaaggctatatgcgtgataccacagaggtagaaaaaagcatgtatcagaatgtgctggccgattattccatttatcctgctgaggtagtgaataacagcctgacgcatgttgataactatattacaatcaataaaggtgatgctgacagtatccgtactgagatgggagtagtgagcggaaatggggtcgtcggcattgtttaccagacttcggctcattacgctatcgtattgccggtattgaattcaaaaagcagtatcagttgtaaaatccagcggacggattatttcggttcgctgaaatggaacggtggttcttcgctttacgcatggctgaaagatattccccggcactcggagttttcattgggtgatacggtggtgaccagcgggcatagtgctgttttcccggaaggtatacctgtaggtgtagtcgacgacatggctgatagtcacgatggcttgtcgtatgtactgaaggtaaagctctttacagactttgcacgcctgaacgatgtgaatgtaatcagttttcgtggacgaccggaacaggccgaactcgaaaataatataaaataaggtgtatggtattgttcttacagagattggtgtggttcgtttttctggtactgcttcaggtactggtgttgaatcatgtgcatattctgggctatgcaactcctatgctctatatctattatatattggtactgaatgctgaaatacctcgcaagtcgttgcttttgcaggcttttttcctgggattatgcatcgatatcttcagtaatactccgggcatgaatgcggcagcagctaccatgatggcgtttgcgcgccgtcccttgctacgtatgcagatgctgcgtgatgtaaccgacgattacgtaccgggcattcgttcgatgggtttttatcctttcttccggtatatcttgagtagtactgtggtatttatggttaccttgcaaataattgatgcttttacgtttttccgcatgagtgagctgatgtggaagattgtgacagatacactgataacggtagttggcataatctgtatagacactataaggaggaagaaatagtggatcggaattataagctggcaaagagaaggcatgtcattggtggtgtcgttctgacggtagtggttctttttataattcgtttgtttgcgttgcagatattgaatgacgactatcggaagaatgccgacagcaatgcgtttctgaagaaaattcagtatcccagtagaggagtgatttacgaccgtaccgggaagctgctggtttataaccagccggcttatgatatcacggtggtcatgaaggagataacttcgctggatactgccgatttatgcagtacactccggataacgcccgattttgtacgccgtaaatttcgggatataaagaaccggcgtttgaatcctggatattctccttataccaatcaggtatttctgactcagctttcggccgaagactgcggtatttttcaagaaaaactgtttaagtttcccggtttttatattcagcgtcgtactatccgtcagtataattacaatgcgggagcgcatatcttgggagatatagccgaggtttccaaggaggaaatggaagatgatgattattatttgccgggtgattttatcggcaaattaggggtagaacgttcgtacgaaaaacaactccgtggagaaaaaggtgtggaggtgctgcttcgtgatgcgcacggacgtatccagggaaattatatggatggtaagttcgataaggctcctgttccgggaaagaacttgacgctgagcctggatattgaacttcagatgctgggagagagattgctggaagggaaaatcggcagtattgtggcgatagagccttctaccggcgaagtactttgtctggtatcttcacctacttacgatccgagcctgatgattggacgtaacagaggtaagaatcatcttgaattgtcgaaagatccgtggaaacccttgttgaaccgtgctattatgggtacttatccaccgggctctacttttaagactactcaggcactgactttcttgcaggagggtatcattactaccggaacgatgtatccgtgttcgggaggtttctcgtatcgcggactgcatgtgggatgtcatgcccatccttctcctctggctttgataccggctattgccacctcttgtaacggatatttctgctgggggttgtatcacatgattggtgctcgtcagaagtatggctctgtgcagaaggccatgaatacgtggcgtgattacatggtttcgatgggatttggttatcagctgggaattgatttgccgggtgagaaacgaggtatgattcctaatgcacagttttatgacaaggcttaccgccgttcgtggaacggtttgaccattatcagtattgcaattggtcagggagaggttactgccactccgcttcagatagccaatctgggtgcgaccattgccaaccggggatattttgtgactcctcatgttgtgaaagagatagaaggagagccgatagattctatttatacaacccgccgttatacaaaggtagataaggtacattacgatgaagtggtacaaggtatgcggtcggctgtactgggaggtacctgccgtttggctaatattccggaactggaggtctgcggtaagactggtacggcgcagaatcacgggaaggaccactcggcatttatgggatttgctccgatgaataatccgaaaatagccattgccgtttatgtggaaaacggtggatggggagctacatacggtgtacctatcgggcgactgatgatagaaaaatatttgaccggtaagctgaccgaggaagacgaagcgttggctaccgatattcaaaaccgtagaattgattatggcttacaggaaagatagtttgtggaaaacggttgactggtggacaattgctttgtatgttgtcctgatagtgtgtggctggttcagtgtgtgtggagccagctatgattacggtgatcctgattttctgaactttacgacgcgtgctggaaaacagttgatgtggattggctgttcctttaccctaggtttcgtattgctgatgctggaagatcgtttatatgatacgtatgcttatctgatatacggaatcttgctgttattgctgtttggaacgatattcaatccgcatgagatcaagggttcgcgttcgtggattgtattgggtccggtaagtctgcaacctgctgagtttgccaagtttgctacggcactggctttggctaaatacatgggtgagtatactttttctatggaaagaggtaggaaaatgctggtagcactggccattattctcgttcccatgttcttgattatctgtcagaaagaaactggatcggctttggtttatctctcttttttcctggtactgtatcgggaagggatgactggttccatcttgtttgcgggggtatgtgccgtgatttatttcattgtaggtatccgttttagtaatgagctgatggccgatggacttacttctctaggagagttcgccgtattgggactgattatattattttcggccttgctggtgaaagcttattgcaaaaacagtgagcgtgccgtcatttacattctttctttcggtctcggctcgatgctactgggctggttgttttctttgtacgtcattccgtttgacgtagtttacttgcaaggagtggtatgtggagccttatgcatctatttggtttatctattcttgcacgaacgcattcgtaattatctgtacatattagtatttactatcggttcggtgggattcctcttttcggcagattatgtattcaatgaagtactcgaacctcaccagcagatacgtatcaaggtattgttgggaatggaagatgacccgacaggtgccggatacaatgtcaatcaaagtaagattgcaattggttcgggaggcttttggggaaaaggttttctgaacggtacccagaccaagttgaaatatgtacccgagcaggataccgactttattttctgtaccgtaggcgaggagcagggatttgtgggctctacgattgtgattctgttgtttgctgcattgatatggcggttgatttatctagcagaacgacaaagcacccggtttggacgagtatatggatatagtgtgctgagcattttctttttccatctttttgtcaatgtgggtatggtacttggattgactcctgtaatcggtattcctcttcctttcttcagttacggaggctcttcgctttggggatttaccattttactgtttgtttttctgcgtattgacgctgcccgtgaaagttgacagacgcatacccacatcgctgattcccttcagcgacttgtcacgcatgatatgaactacctgtagcaaactgtcggctggcgaaagatgcagaggatgatcttgggtacatgtaaactgatacatattgcctgctgtacctttgcctttccagtttccccatttatcggctaggctcaagtgtaacgtatccggacgtctgtctggacttagtgggtacaatacttccagccatatatcctgataaggatagttttccgtatgtcttaatcctacttccagctcataggtatgtcctgcaagctgggaaggaagtgtatactccagcatatcctgtttgttccagccgttgctgctcaggttttggtaagtatggtaaaccgtatcatcatggcatgccgcaagggagaataataaacctaatattccccctgcggtccggatatatgatgaagtttttagtgtggtcatgctatttcgttgttattctttcgtgctggccggcgtggacggttaggctgtctgttgtttccttccggttgcggctgctgtgtacgtgcctccggttgttggttgggctgctgtctgttgtcagcctgacgtggagctgttccttgtcttttcccttccggttgtggttgctgcgtacgtgcttctgcctgctggttggatggttgctgcttgttatcggcctggcgtggagcatttccttgtctttggcgattacctcccttttctcctcttcgcttatcaccgccctggcgctcttctttccgtctttctcttccaccgttggcaggagtattggaagttgcggcattgttctctacccgtgcctgtccttctgtcttttcctgacttgatgcattcttattgggaaggagcttttgtggattggtttcttgaatagtggcctgacgagcttctccgtttttcttcttattcttacggttcttgccgtttttgcttttatcgaaacgggtaacactttcctgttccagcaagtctttcggacgtgccggctcatgcatgccgttgtcgttcagtttctcgggcttttctccacggcggttcatgttgataacctcaaatgcacggcgtgctgtaattgttacttcgttggcaaggaaactcttgtcggtagaataaatgatttctcctttcaggatgtcggccttgaagtaataatatgttgcatccattgtttcgagggtgatttccttgcttggcaatcgtttctggcattctacgtaagcgtctacttcgtagttgaggcaacatttcagcttggcacattgtccggccagcttttgcggattaagcgaaatatcctgatagcgggctgctcccgtagatacagaaataaaattagtcatccacgtagcgcaacacagttctcgtccgcacggaccgatacctccgatgcgtccagcttcctgacgagcaccgatctgtttcatctcgatacgtacacggaaagcctcagccagtactttgataagctgacggaaatctactcgttcatcggcaatgtaatagaaaatggctttgtttccgtcgccctggtattccacatcaccgattttcatctgcaaacctaagtcggcggcaatctgacgagaacgaatcatcgtagcatgttcacgacttttggcctcttcatatttttccatgtctaccggttttgccttgcggtatacacggcgtatttcagcatccggctttatgtttgccttacgcatctgcaacggtacaaggcgtcctgtcagcgttactgtaccgatgtcatgacccggactggcctctactgcaacaatatcgcctttttccagtttcaggtgattgctgtttttgaaatatccttttcgggtattcttgaactgtacctccaccatatcctgctcttcgctgttaccgggaatatcggccagccagtcgtaggtattcagtttattatcttgtcttccgcagcccttacagcaaagcgagccacttccgttcttcaatataaatttgttcatagtttcaattctttagtagtacaatcattttcagggcgaaatcgaagaaaacgaatttgggatttacgttttgttcgatatgtcgtccggcttcctccagttcatccatgatacccatgacgttcctttcgttgacgaaaggtgcaaatcgtgaagcgaattgagcctcttcgcgtcccaggtaattcatttccggctggtggaagttatatataaagttttcccgtatcatgcgctggcagtatgccaataaatttttctgccgttctcttcctaatgccgcaacctgctcgctccatgctttcatttctttcaggcgtcgggcgtatgccagtcgcatcagagaagtaaacagtgtaaagaatagtcggttttcttctcccaaatgtatgttttcgatggcgcgtaagacacttccggcagagaggtgtgcaatatcggctgcatcttcgggctgaagcatatagcgcgtgcgtaataatccggcaatatcctcctcactcagcggaggcaggttaaaccgttgcatacggctggtcagtgttggcagaatatattccggagcctcgctgaccagtaaaaacagggtataggcaggaggctcttcgaggagcttcaacagcttgttcccacattccgcattcatcttttctgggagccatataatcatgattttatacccgccttctccggctttcaacgacagcttccgttgtatttcgtcactttcgcgtacgaatatctgagcctgttggttttcggctcccatacgtgccagccaatctggtagtgagaaatagggtgaatcaatcagctgctgacgccatgcatcgataaagtcgtcggacaccgtgtcacgtccggcttttttcttgatgacaggaaaagcgaaatgtacgtcggggtgaaccagtttgttcatttttacacacgaaggacatttcccgcaagcatcttcttctcccggattttcacaacacaggtatcgtgctaaggccagcgccaaagggagtttacccgttccctccattccacagaacagcatggcgtgaggcacccgcccttcatggacgagtgtcagcagatggcgtttagcctcggtttgtcctatgacgtctttaaaaaacacggttaataaatttctttggctacgcggcgtacgctttccgtagctccaacagtataaaaatgaatactcggtacaccgtgagcaatcagttcacggcattggttgatacaccattccactcccaattgtcgggcttcttcgtcggttttacatttcaaagcttccagagccagatcctgcggaaggtcgactttaaatgttttaggaactaccgacaactgagatagtttgctgaacggtttgattcccggaataatcgggatatcgataccttcacgacgcacacggtcaacaaagtcaaaaaatttgcggttatcgtaaaataattgcgttacggcatattctgctcccgcttcaaccttctttttcaaccagtaaatatcctgttccatgttgggagcttcttcatgcttttccggatagcaggcaactccgtagctgaaaggatgtacaggagctttaataggagaaccgtcgacgaatactccgcggttgaaatcattgatttgctgttccagctccacggcatgtgcatatcctccgggttcgggagtaaagacttgctcgtgtttagccttgtcgccacgcagaatcagcaggtcggtaatacctaaaaattgcagatccagcagaacatactccgtgtcttcacgtgtaaatccactgcacaagatgtgtggtactaccgtgatgttatatttgttttgtatggctgctgccactgctaccgtacccggacggcggcggattcgcttgcgttcatacagcccgttacccagttcgcggtatacatattcgctgcggtgtgtggtaatattaatgtatttcgggtcgaattcgcgtaaggaatcgatggtttcatataatttttctatccctgtgccttttaaaggaggaagaatctcgaatgaaaaggcagttttctcaggtgatttgattaagtcaattactctcatttcactatttttgcgccttgttagggtgttacatatttggcaaaaataagaaaaatatcgtacttaacgggagaatgtttcttaaaaattttaatttgtctgccgatacatcagagcacgggggtaaacaggtgagcgaaccatccgacaaagcgtttccacggtgtccgtttcttgtaaacctctttcgtcattatcgtactgttttgcttgtcggcactgaatatctcggtcagttgggccgtgataggcaggtcgaatacaaacgcgttgatttcgtaatcataccgcaggctccggctgttcaggttggtacttcccaccgtacagaaccgttcgtctaccatcatgaccttcgaatgatgaaatcctccgttgtagacatagatatgcgctcctttttttcggaggcggttggcaagataaaatccggcatcgggtgtgaaactgatgtccgatttgccgggaatcatgatttctaccctgactccacggtcgacagccttttcgatggcatggcgtatgctggcagtcggagtaaagtaagggttgatgatttgtattttccgttctgccgcattgatggctgcaatgtaagcgtgcctcattgctttgggcgatattttcgggacgcgctgtacaatagctacctgatgaccggcatgtatcggaggcgcattcagtgaatcctctccaaaagggaaaaattcatcgccttctatatgctgcttggtctctttgttccacattgttaaaaaagcctcttgcagtttttctacagcaggtcctttgatacggatatgcatgtctctccatgctccgattttaggcagtccgtttatgtaatagtcggcgatattcattcctcctgtatagcctactttgccgtctatgactactattttctggtggtcacgactggccgcatggtttacgtacggaaaggtaatcgggtcgaatgttataatttctattccccttttactcaatttcttgaggagcctgttgcggagtggacggttattcgacatatttccgaaagcatcgaacatggcgcgtacttttactccttccttcactttcagtgcaagtaagtcgaacaaggcattcccgatggaatcgtttctgaaattgaagtattccagatgtatatgatgttttgcctttttgatttcttcaaaaaggtcgttgaatttctctctcccgctgggcaacagtttcagctcattattgttgataattgccacgccttgttcgcgcaagtatctggcaaataatgagtcagcaggcagatattcggtaatggtatcttctgctgcttttgccgtaaacgattgtgattgtgcacggcaaggcacgccgaatttcacaatcaataagactaggcaaaaaaatattttgtgaaatttgtagtcattcatgcatcgatagtttttgtgaggtgcaaaaatatggaatttaattaagaatttgtaatgattacacttgcttttcataaaatagtgactatttgactgtaaaatcagatgaaatgactgatttgattagaagaaagtaaggtataaagtttgggaagcgatgaagactattctctgaattgcttttgaaatttgtacaaagaaaaaaagtttttgtacaaaaaaataaaaaacgtcgagaggaataaccgcacaattgcgcgttttccccttaaataatgactttatttatgtctttttgccctttacgcccttcacaaacgttggaaaattaacaaaagagatacttttctcttgtattagaagactgattttcctcctgctagaaagacctgtgaaggcggtgaaggcaaaaaagacaaaaaagttttttattttgccggatgtttccttattgtcagccagtaagccgttaccacaagtataccggttaccacccacgaaatagggtagacatagagcaatacgtcgtatcctctccatatcggtgaaacacaatacacccaaatgatacgaagcatgcaggtacctactacagtcatgagagcaggtgtaagcgactttcccatacctcgcaaggaagaaccggctatctcgtaactgcaagcaataaactggagtgccagtacgatgtgcatacgtatgcttccgaagtgctgtaccatgggcatatcggagaagaatcctaagaagaaactgtgctgccaggtgaatatccagctgaaggctgcgcagagtccggcacttgctcccatacagatccagaaaatgcggtgtaccctgtccatctttccggcaccgtagttctgggcgataaaactgatagccgccccattgaagccttgaatgatgaaataagtatagtattcaaagttgagcgcagccgacgaaccggctatggcatctgctccgtaactgttgatagacgactgtaccactacgtttgagatagagaatatcattccctgaatgccggctggcactccgatcttgagcatacgactcagttccgtaaagttgatttttattttattgggatgtaaccggtaaggttctttttccttgagaagcagccgaacgatcatcgtggcactgaatatattggctatgccggtcgcgattgccactcccgatacccccatgtggaaaacaagcacgaacagtaggttgagaaaggtgttgataatccctgccatgaccagtatatacaaaggacgacgggtatctccgatgcttcgtaagatagcagctccgaagttgaataccatgataaaaggcatggcaagaaaataaatgcggagatatttcacagcttctcccaatacctcgggtggagttcccatccatgtcaatatcggtcgggctaccagtactcccagtatgagcaggaatataccgctgataatggcgaccatgcctacggtattgatggcattgcatatactcttgtgatcctgctggccgatgtgattggaaatgatggcacatgctcccatcgagatacctaaaaagagattgataagcagtcctatgacgggggcattgcttcctactgctgccagtgcttcgctgccgatgaaatgtcctactacggcgatatcgattgaattgaatagttcttgtagcagactgcttgctgctaacggtaatgcaaagaatagtatgttcttgaataacgggccgttcagcatatctatttcattgcttttcggctttttgctcgctatggttgtatcactcatgttttacttgaatttgtaacgacctgcaaaattataataaattttccagttgtggatattgggataagtttgtaatgtttaagggacaaacagacaattggataaatctgagacgtttttattactaaatacataaattatacagatataagattttatatagataaaagtgttaaaaaattgtttgtgagatatttgttgcttatttttaggcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgtttaggtaaacctatttattgatactatgaaatccatttgtctcttattcctgttgattcctgcattcacatttgccgcttcacagaaatatcttgcgaatgtagaaaagaagctggactcactgttctcgactgaaattccagatacggccgttttgaaggctgtaaggatagttacggaggacgattcactttcttcggaagaaactgaacatttttatgcgaaaaagatttttccatttattgaaaagaaaaaagcgaatgtgtcccatctcatgttggctgtagcttaccggagccgtgccttgacggtatctaaatttggagagatagaggatcaccgtaagtacatggaaatggcttataaccatattcttaaagttggtgataccggatatcaggaactacggcagaagggggccgtatgttacagctatgcttccatgcagctttttttcggcgatatagccaaagcccataaagtcttttatcaggctattcgtgctgccgaaaagataaaggattacaataaggtgatggaaagtttttatgccttggctatctattatacacaggtaaaagatacccaacgtctggataatatccttgccgacatcagggaggtctttcggaaggctgatggtgatgttccgccaagggcgtactattcatggtattcggtggctactgctcgttatgctcttgacacagaccgtccggaaatgagagattctgcacttttatattccagaaaatcgctagacattgtggaaaaatatggtccggaactggaacggggtactgccaattttgcgtggaactattataatcatgcactgtttttcatcgagaagccttatgtaaatgaagatagtgcttcctattatctggaaaaagccagacgtgtgccgcagcgtctggcgatgcatgcccgggaagtggagctgaatgtacgctgtgcgtatgctacgctttataaaagtcagggactgtatccgaaagccatcagggtgtttaaagatgcgctgcgtatgatggatgccgatacgataaacaacggtatccgtcaggagcgtctggatgcttatgaaaacattgtttcgatggattcggctcttggtaattataaggaggcgctggcgtatcagcaaaagataatagattaccatcaaaaggtttacgacagtgaacttgcacggcagctggacgaaatctcaactaaatttggagtagagaagaaaaacctggagttgcagaatctgaaagaacgagaagaacagcgtaccgtcattcttcgtttgcttatcggctcgctggtggctgccgtggtaattcttgtgtttgtagtctggatttatatactgcatcgtcgccgcttgcaagaccgtctttatcagtctgctcttgagtcggagatgaatcttcaggaactggaaaccgttaaatcgcaatattctgacctgaaggatagtcttgaatccagacaggtattacgtaattttgaagttgcagtggaaaagatgaaatcggttgttacggcagcccgtttagatcctgctgtacgcgatgaatatatacagaagctttcaactcttaatttagtagcatttgaacgtcagtttgcgacttccatttctcggatgacacaaatggacataaagtatattctttgcttttatcttgattttgaggctcgcgatattgccacgatttttagtgtagagccagccagtgtgtatacagtacgttatcggttgcgtaagaaattcagggacaatccttcttttcagtttcttatgaagtgattttttatggtgagacaggtatttgtctatatttgtctatttatttgaagcacagattcggctaattttatttgcagaagataagaacgtcaacattatgcaaaacacagaatttctcaattccgaactgacagagtattctattttggtgattataaaaaaactgtgtgcggtcattgtcgattcggaagcaagcatcagcgatgaacggaaagtgaaatatcttcatcgtttggcttcctatcagataaaaggtgaagagggaaaggctattttacaatgttatcatgttcttactcatacggatatcagatatcttttgtgttttgctatcggtatggaatatggggatatccagaccttgtttcatatagaaaaaaagaccatttattcagtgcgctatcgtatccgtaagaaactgaaaaaagcagggaggagtaatgtggttgctcccttgaccggataagagacagatattccatttgttcatttaaaataaaagcctatgaaaagtttgttgtttgtaatgattgcaggtttggcctcagcggcgatgttagtatcttgtggaggtaatggaagcaaagcttcagcttcgggaccttttggagaaataccctcactagtgagtgattttgaaactttttcggatgcgaaacaggctgaattgcaaagtggaggtgaggataatatgaagaaaatcctcgaagagatgaaagcagcagaggaaaagtttaaggagtcaatgaatgctgctttcgaaaaagtgaaaggcaaagaggtggtaaccgaaattgatccggaactaccgctgaaggttgtcactcctatgaagatagaagatatatctgtttcacgtcatttggttaagctggttggtgaattggaactgacggccaccgcaatcggatttgattcatacgagccgaccgatgcattcgaactggatgacttggtggtattatcttacgacaataacggtaagccttttgcatacgacagattgtctaaagacatgggaggcgaaccaatgccggctggttcgaaagtgcctgtcgatacgcatattcatattgaaagttataatgcggcctctatgggatgcttgtctaaaatactcattactctgaaaggaagcgagctgtatgatcaggcaaaagcggcagccgatgctttgaaaggaaagtaaggtttggatatttgtattgactctttatctgtctgtctttttgtgcagactgattctgggataattggtttataagaaaagatcccggctttcactcaaacgaaggccgggattcttgttttaagagtgttctttctactggtttcaaggcatatctgtctttaatgttaaaaaatgacttcttgttttattatgaacatttgttcattatatttgcgggcggaaacaataaatacattcatgtcaccacgtcctaaaaatatccgtaaaatcaatgatatgccttctgtggcaggatttaagccgatagcttcaagctattgtcgtaaggatactatattcttgcattttgaagagtatgaagcgatacgactgtgtgattatgaaatgaaaacccagcaagaagcgtctgtttcaatgggagtatcacgtccgactcttagccggatatatgtcagtgcgaagcaaaagatagccacagcattggtacgtggggtggcgataatgatagaaggcggagtatcgtataccgatagtgaatggttccgttgtggagtatgcggctttttattcaataatatcaatccggcacttaaaatccgtaagatagaatgtccgatgtgccactccaatgacataagcataagtaatataaacattaataaaagtgagattatgatgaaaattgcaattcctaccagagataatatggttgacagccattttggtcactgtgagtattatacaatcttgacagtaggggcagacaatcaaattctgagtagcgaaactattccttctcctcagggatgcgggtgtaaatctaatattgcgggagaattggaaaatatgggagtcagcgtcatgttggcaggaaatatgggacaaggtgctttaaacgtattaaccacccatcatatcaaggtgataagaggttgttcaggcaatattctcgatgtggctgctgagtatttaaacggtactcttactgattcgggagtaagctgttcatctcatgaacatcatcatgaatgccatgaatatgatcataaggagtgatgtttgaaaagtaagatattacttgatattagtattgaaaaggggccgtttcataatgaatgaacttgagatggcctttttctttaaattaatattatgcttaaagtaacgaagctttcggtttttacgttgagcccttgtagcaaataatcgaaattgcagcttttataaagaatacggttgacttcttggtttaattgctggtttaatttgctcgattaaaccgccgcttacagcgatatgcctaaaaacaaaaaagcatcgacaatcatcagattatcaatgctttcttccagtcggggtgactggattcgaaccagcgaccacacgccccccagagctatccgtttatttcctatatttttatatctaattgtttttcagtatatttgccaacgaataagaaacggagtattggtattatttacatctgattatctatattttcggtacaaacgtcagtaatccgtcagtaaaataaagtagataaatcattggtaatccgatagctatagtccaatattttttagcaaaagtaaaatgtcagtaatttgtgtcgcttatgaaatatgcttcatttaaaatgtggatagccgataaatatcactataaagaaggatatgctatttggttagttgttcgcaagaataacaaacggaaggtaatggcgttaggcatttatgcagaaccgcatcaatggaatgacaaacttgaaatgtttgtcacagataagcgtgtccccaaattacatccagaccgaatatacctcaatgaatggttaacgcaaaagaaatcggagatacttcgcattatagcagattttgatgctaataaaattgattggacactaaatcaattcgaacaagaattctttcactactcaaacaaagggaatgtaaaggaattctttgaaaatctaattcaaacttataaagataccaatcatattggcaatgccaattgctatagcagaacacttcacgtattagaactttttgatgagaaactgcctgaacgtgttttccctgaaatagatattaaatatgtaaaatcttttgatgtgtttttacaaaaacgtgaatgtaaagggaatactcggaagttctattttaagactttacgtgcagtattgaacaaggcaatccaagatggtgaagcgtcagaaacgacttacccatttggcaagggtggttttagtatttcagcattggaagaagaaacagcaaaacgctacttaccacacgatagtatgatgaaattaaaaacaacagtgatggataatgctgtactcgaacggacacgaagattatttctcttttcatattactgttatggtatatcgtttatagatgcagcattgctaactaaaaagaatattatccgttataacagtggaaattatattgtctataaacggaataaaacaaaagaagctaagaaagtcaaacctattcagattaagataactcctgaaatccaagagttaatggattggttttcagccaatacattgttagtagaagattacttgttgccaatagtttctattgcaggatataaaggagagcaactttataatcatattcgtagccgttttggacgtaataacaagaatttgactaacttagcgaaagttttggagattacagacatgaagctgacaagctacgttagcaggcatacaatggcaatgaccttacaggacaatcaagtaccgagagaggttatctcacaaatattagggcatagtgatttggcaacgaccaatacttatttggatagttttgccagtagtgtaatagacgaagcggtaaaagtattataaacgaaacagtatgttaccaacagataaaataaaggacttgctttcgcatggcgagaataagcgagtagaattcaaaaaatgtacggataaggtttcggcatctgtgtatgaaaccgtatgttcttttctgaatgcagagggaggatatatctttttaggggtagatgatgatggcacaatattgggaattaaccctaaatgtgtaacagatatgaccaaaagcattatcaatacgttgaataatcctgaacaatttcttccacctatgccgatcaccccggagcgcacagagatagacggtaaagttgttctttatttgaacgtgccggagagtgaacaggtacatagatacaagaatcgtttctttgaccgttggggggatgcggacaatgatgtgtcaaaacatacctatctggttaagaatatgttcatgcgaaaagagaaggaatcttccgagaacgaggtatttcccgatgtgactttggaagatatggatgaagaatcgttcaagattatgcgtagccacatttctattcataactccaatcatccgtggttgagtatgacaaatgaagaattcctgaaaagtctgttttggggtaggcaacgaggaacaaacaaggaaggatataagttggctgctattctcttatttggcaaggaacagactattctgaactgttgtccgtggcatcgtacggatgccatttaccgcagcatgtcttacgagcgtttcttgcatccgcttcctaccgaccctgatattcgttacaatgaccgggatatgatatgcgcaaatctgattcagtcatatatccgtttgctgaatttcgtgcaacgcaacatgcctgataagttccgtttagcggataatggaatagaccgtttggacttacgggtaatgatattcagagaggtaatctcaaatacacttctacaccgtgagtatatcagttcatataccaataagtttctcatattccgcgaccgggttataacggagaattggacgaaacctttccaaacaggggatatagatataaatgattggcgcacccgtacaaagaatccgctaataacaaaggtgttccgtgagatgaaatgggctgaggagcttggttcgggacagaaaaatattcggaaatatgctccgttatattttgaaagttctgaaatagagatacatagtggggaagagtttatcttttctattacctatcgtgaccctaaagagtttgaacttgcagaaaatatgctaacaagtcgggatcaagtcggcactaagttggcactaagttgggaccaagtcggcactaagttagcactaagtcaaaaagaaataaaaactattttggaaatgtgtttgtacgaaaacactttgacacagattatcgcttcgctcaattttagcgataggacgaagtttaagagaaaatatataaaccctttgatttcggaagaactactggctatgaccgttcctgacaaacccaatagccgttttcagaaatattatactacagaaaaagggaaatcattactactatgccaagacgaaagcaattgacattcaaaatcaaagacctgagatgtgcccagtatctgattgcggagttgtcccaactccctcagctggcaaactttgatatgacttctattgagataagtattaaggaaaacagacctgcccctaaaatcataaagaaggacatagatgtactgatagaccgcttgcaacgtggattctccgcaaacaaacatactcttacccaactgaacggaagatatttggtgacaaacactcatttagccaaatggatgaaaaccacccccgcatctgtaaacaaatggataaaagacgggttgataaagccctgccaagacccacatgtatgctttgattattttaatgtggatgaagtaacgaagcaattacgcaagcaaaaacaataaaatcacatttcaatttatcatctatatcaaaagtgccatttgatgccattctgaggacagacgctgccaaacctctgaatggcattatttgtatgtcctcttgtggcagctaatgtcttcttttgtctttgttaatgcagatatttattcgttttataagctcttctttttgtttttcctttgcatcatcaacgttgagatagctgtgacgacagcttattgtctaacccctaaaatgtttgattatggcaaatattattgtcgcaacagaggagcaaattcaagaagctgtattcaatgcggtttcaaaattcttttcaggaaatcaacagactatgttcagttctgatttgcctgatacactaagtatgcccaatgcgctgaaagtattggaagataacggattcccgacttcaaaggcaaaattgtacaaaatgacttcgcaagaacaaataccttttatgaagtatggaaacaaacttgtcttttcccgcaaagctcttattgagtgggcacaccagcaactggtttcaagcagtcatgaaaattgcgattcggcaatcagcattcagaaatgtttcaaacgtaaacgctaaaactatgagtacaaaagaaacactaaagaatgaaagtccgtttgtgcgggtaggaacaacactttacaagatagtaagccagccccgactaaatgggggacatatcaagaaacgcatcgtatggaacaacgaaacgctccgtcaagattatggtaaggattatttagcgggtgttcccaaatacgatggcttctgtaccatccctgaccatgtgaactattgccacgtgatagacaattttctgaatctgtacgagcctataggacacgaaccaaaagaaggagatttctcccacattcaggctttgatacgccacatctttggggaacagtatgagttgggaatggattatctgcaacttctttacttgcagcctgtacagaaactgccgattctgttattggtatcagaagaacgcaatacggggaagagtacgtttttgaacttcctgaaagctgtgttccgcaataacgtaacctttaacacgaatgaagattttcgtagccagttcaatgcggactgggcaggaaagctcatcattgtagtggatgaagtattgctaaaccgtagggaggattcagagcgattgaagaatctcagtaccacattgtcttacaaagtggaagctaaaggtaaagaccgtgacgagatagctttctttgccaagttcgtactttgttccaataatgaaagtctacctgttatcattgacccgggcgaaacacgttattgggtacggaagattcatcgccttgaaagtgacgatacgaatttcctgcaaaaattgacatcggaaattcctgcttttctttacttccttcaacatagggaactgacaaccagacaggaaagccgtatgtggttttctccgaagttaaccgagactgcggctttgttgagaatcatccggtgcaaccgtggcaaacacgaagtggaggtcatggaactgataagggaaataatggacaacgtgggaactgacagattttctttttgtttgaatgacctgcttaacctgttgaatctttcgggagtgaaaatcgaaaagcatcacttgcgcagaatcattgcagaaagttggaaattgacacctgcccccaatggactgacttataccacctatcagtttgattataataaggaatgcaggtttgctccagtcaggagggtaggacgcttttacaccgtcagtagaacattgctggacgaactttgattattttgttgaattgttgaaataagcaagtaacttattgatgcttagcttacaattatttcaacaaaggctcaacattcaaaatatgctgttgaaaagaaaaaataattgattctcttttcgttggcatttgttgagttgctgttgaaaggtacatctttgtgtatcaacttaatacaagatgcgttcaacaattcaacagtttttactaacaatcaaatccgtatagaaaatgacaattgaagaagcaaagaatataaagctgacagactatctgcacagtttgggttatgctcctgtcaaacagcaaggggcaaacctttggtacaaatcaccgtttcgggaagaaaacgaagcatcattcaaagtgaataccgaaatcaataagtggtatgactttggactgggtaagggaggcaatatcattgcattggcttcggaactttactgttccgtccatgtgtcgtacttgctgcaacggattgcagagcagacaccgcacatcagacctgtatctttctcttttcgggagcaatcctctactgcacctaattttcaacatatggaaataaagagactcacttctcccgctctgctctcctatctgcaaggcaggggaataaacttggaacttgcgaaaagagaatgttgtgaggtacacttcgagaacaacggtaagcgttattttgccatcggatttcgaaatatggctgacggttacgagatacgcaaccgatacttcaaaggctgcatcgcaccgaaggacatcacccatgtccggcatgaaggcagaagaaatgatacctgtttcgtattcgaaggattcacggactatctctcgttcttgaccataagaatggagaaatgtcccaacatgccgtgtttggactggcaagactatatcatactgaactcggtttccaatctttccaaggcgattgacgagttagccgtctatgagcgcattcattgttttttcgacaatgaccgtgtcggaatggaagcctgccgaaaactgacaaacgagtactcctatcgtgtccgtgacgcttcacacacctataaggattgcaaggacttgaacgagtatcttatcaagcaacgtcctatacaggaacagaaaaatgtacaagttgcaccgcctaagaagtcaaaagggcggagtttataatatccacatgtattatcgctgtactggcggaagccgtattgtctaatggagcaaggttatggaaatgtatacatttccgaccttgctttgccggaagcaaagacagtccgctcccgttggtcgcaattaaaaggaaatttcaaaatgaaaaaagataaacaacaaccacaaccgaccaagcgtaacaagatgcgtgtggtcagtgcaagatttacagatattgaataccaagcggtagaaaaacgcagaaaagatgcaggcgtttcactcagtaggttcgtccgctccgtagtgctaacgggtaaagtagtacagcgcatcagcaaggcggatgcggacatactccgtaaattggcaggggaagccaacaacatcaatcaacttgcccataaagccaatgccggaggatttgcgggagtagcagtcgaacttatgttactgaagaaaaagattgttcaaatcataaagctgttgtccgatgattggaaaaataagtaaaggagcaggattcagaggctgtgtcaattatgtattaggcaagcccgatgcaaaactactgacggcggaaggagtgctgacagacagcattcagacaataacggattgttttcagtcccaaagaatgatgaaaccacatatccgccaacctgtaggacatatatcactcagctatgcacccgaagacgctccgagaatgacggatgaaatgttggtctgtttggcaaaggagtacatgcagaaaatgggaatcaaagatacccagtatatcattgctcggcacaatgaccaaaagcatccgcacgttcatattgttttcaatcgtgtggataacaacggacgcaccatcagcgacaagaacgactgttatcggaatgtcaaggtctgcaaggagttgaaagaaaagtatgggctttattttggtaaaggcaaaaacagggtacggactcaccgcttgaaaggaaacgataaaacgaaatatgaaatttaccatgctgttaagaactcattaagcaaatccagtagttggaagcagttcatatcggaattatccaggcaaggaataataacggagttcaaatatagaggcaggagcaatgttatacaaggcttgtctttcgccaaagacggtgttacgttcaaggcttcggatattgacaggaatttcagctactccaagttggacagaatgttgggagaaaccaacagccaataccaacagaatattggaatggcaaccaacaatagacaacctgcaatacagcatgagaatacttatacctcaagcagccatatagcggaaagcattgtcggagcgttgggcggattattcaaccctgctcctaattatgctgatgaaaatgcggaagcagcctttcaacggaaattgaaaaagaagaaaaagagaagaataagctggtaataacaaaaaagatacgaaaatgaaagaaatgaaaaacagcgattttatccacacgctggatgcagtatataacctctgttccgaaatcaaagaattgctaaatgtagaaacggagaaacaagaagatgagggtagtgaaggtattgtcttactttcagacaacctgcaacggcttcaatcggaaataacggaaatgaaaaccgaactatcttctgacagagaaggacgggaaagacttcgtaccgctataaatttgcggttaaaagaagtcaaagaagtatattcagttctgagtacaaccaacggaaaaatatttgccgagcaagaacgaatcagcaatgaattgcaacggcttcgaagcctgaaagtccaaaataaccatacacacgttattgacttcaagacttctcgaccttttctatggcagactgtcatgactatgataattctgtttcttttggtcggcaatgcctatcagttcaagcagaatctgaatttgtcggataatgacttgaagtaccgccttatcaaaatgtatggtggtatttcgggcaatgaattggatacgctggaagtggtgttccatcgtgacagggataaaaccgtcattaggaatattcgtaatgaagtagaagattttgagtaccgcatacgtgtaagggctgagaaattggaacgagcaagattattacaacaggaagcagaagccctgagataattattgcccccaacaattcgtttgagttgttggggacaataattatctcttaatcccaccatcctaacagatgatattctaaaaacctaaaaaacaaacaatatgctttacggaaacggacttcatgctcgctatcaatttcatacctgcccagcgatttatgatatacacggaagcgatgtttgtttctcatattcacataagggatgggagtttcagaattttcgtccatgataatatacaaaagttttgtagcaattcgcatacggctaatatcatgttccgcacgagctaaatgaccaaagttctcccagtagaaaataatccattctaatttgaatttcaatagatttaagaaataatgataatcgtagtccgaattctcattcatgaacattgcccaaatctgtaagcggtctttccttatgcccttttgatacgctttccattctttttcagagagtcctttgcgaagtatgaaatgaaattgctctgaccaagtttcatcatccattgggttcactttcttctgatataatggatttttccgcatggattcttccatattttgcacttctttccttttgacttgtgcccaatcttgaaaataggattgagcatctgtatatttctttttcatttgcatgtgagattactgtttattgtataatgaactcattttctccacagattgaatcatttcttcccgaaaagttaaaggagcaagcacctccacatccgcccctcttgaaagtaattcctgtcggaagtctaaggttgttttcatacggtactcaaagatagaataatcttccgttgtctcaatttcgtattgggaatggtgcaaaggcaaagcacgaatatactgtacatgcatcccatagactttaatccgaatcgtttctagtttcttgttttcaatcataatgccgaaatagtctgcaaagtaggcttccggggcaaaatctttaggataaacaaacttcgtgtctaaagtagtcagttgctgtattctatccaaagaaaaggtacggatattattccgttctttgcagaaaccaatgacataccatctttgcttaaatactttgatgcaataaggttgcagcgtataggtacttagttcctcataccaatagctttgataatataattctatttctaagccgtcacgcatggcttcaataacagacgtgagatattttctgccggaaggaatctcttcaaacagaatcctgcgtttcaaatgatggctttcgtttatcaggttattgaccgcaaacgtattaagtaaccagttgcggacacctcccttttgcatatcatccgcattctcaatatagtagtaataacctccctttcggttgcagttgatatttatatcaaacacttgttcgatggctatacgccagttatgaaaagtccttaatggaatatcttccccttcactcaatcgtgaacgaagccaacgctcgttaatttcctcaaacgtgatttttccggctctgtagatagtatctaccaaccagatgtatttgtcgaataaatcttttgtcatactattcctttttgtgagttccttctacaaaatcagctatttgaacagtttttcaagatgctcttgaatcatttcttccatttctccgtaataagtgatttcccaaagcaatccggcggtcagttcttgtggtctgattactatatcatattcaatgataatcctcatgcctaatatttccgaccatttaggatatgttgccataggctgacaaatttcatccctatttttatcgtagatggaacaattcatatcaatcaaaggcgagcatccttcccagcgggatgccagatagatgcaatactttgactctgacggttcaagcaactgaagatactgatacacttttcgataagcttcccaatctatcttcagaaacgatttgggtgcattcctttgatacaagcttttgaaatcacttaaaatatcatcaaaacagaaacgtgtaagcaaatacttaaaggtcaaatgttccatatcaacatccattaatccattacgcttgtcatacgtaatttcccaaagtaagcctgctgtcaattcttctaatgaaagcacaatattgctattgatgatgatttccatgcctaaaatctctgacaaatagggatagctacctattcctcgatagtcgtaatcatttccttcttcataatataagcaacaattcaaacctataaattgcaactcatcccaacgttcacttatttgaatggcatacttagatttaccttctttttctttacggatttgtaagtcttgatatacatcccgataaatatcccaatctgtttgctcaaacaagtcaggtcttatcttccgatataaggctttaaattcaggtaagatgtcatcaaaactgaatcgagtaagcaaagatttgaatgtcagttgttccataatgcaaagttttgagttcgataatgcaaatatcgcataaagttatgccaaactaaagcatacgctaaaaagattttattattatgaggaataagcattcctgtgcttctgtttggcataagacaaacttatttttgctacatcattaaacaaataatacgattatggatttatatgcagaagatttggtagactacatctatcaagaaaatgatgtgaacaagaaacggacattgctgctggaagtggaagcggaaatcaagaagctcatgggcgaacaggaaaaggggagccttgatttgaggcatatcggcgcagtacagatagaaaagatacaagatttgatagatacacggagcttgattctcaaccggatgtttcaagccacttcgcaggaaatccaacgttttgaatcagtaaacgaattgctggatagtttgaccaagaaaatgtatcatcgcatggcaaacctctatcgtacattgattgacagccccaaagataaatcttttgatgacgattatgtggtttccggtacgctgaaatatgtatataatgacgaggattccatattgattttaccggaagatggttattatggttccgactttgcttatatgattgaattgatttactatttgcttgaggattacaacggaggagttcccgaaatcgaagaatgctcctgtaattactcgcctcaaaacacttccgatatgacagatgagcagttgcaatgtgtggatgtatgggatgatggagtgacatgggcagaaggacatttacgccgtccggaactgaagcatattatcgtatgtcatgccgtacacgacatttgcacgcataagccttattccattccggacttattgcggttaaatgatttttgggtagaagcccatctggtatgtcagcatatcatagaccaaaacggaaagcgttataactcggattaatcatttgttttgcaaagtgcctgaaaggtggagacattgccaaactttgtgctccacctttcctcgcatagtcctcctttagaatgcacatgaccgaaaagatgatatttcggctggcgttctaagatggtttgtttcaatatctcactgcccgtaccttcatccaatatgcctttcgggggaatgtgagtaatcaaaaaatccgttttattaggcaacccacattcccctcctaaccattgcatttgctgaatcattttgctggaaatggcatagaaagtaatgccgtcatattctataccgcaatcttcaagcaaagttacatttgcaggtatcaatcggcgggcttcttccagacaaaggtcgaaaatgatttcgtgattgcccggcacaaataagcgaagctgtgccggacaggaagaaaaccagtcaaagaaatcactcaactcgttttcttgaaaatccgatacgacatcccctgcgcaaatcaaaatatctgtatcttgggggatgtttaattttcggtgcataccgtgcgtgtccgaaaatgcaaacaaatgttttcctttataattcaatctcattcgtatttcttctgtctttgacgaagtttcttccaaaactcccgctcttcccgaacgatttcttctgtttcttcccaatgtgaataagtcatctcggagaagcaagcacaaaacacgtctgcccaagtcacttgtggaagcatcatccatccttccttttcccttatctcaacaggcatatccaatgtctcgctccaaggagtggaattcataagaacatcttcaaggccttggtggacatatttcttttcgcgatggctataaagccaataataggtataacctccttcacaaacgatacggtcaatgccggtatagcagaaatccttccgcgaacgcatatcgtcaaacgctgatttatactgttccaaagaatggcattttataatgggatatcctccttctttcattttggctttcactccactccaatccatgcaacgcatataataagagagtggaagaaaaacaggttcaagtggggtttccgtgatacgctcgcactcttcccctttattgcttttcagtaaaatataaagagaagcaatctgattagagttttgagtattcttcatgcaaactttggctaatgccgaatatcgcggatgccaatccaaacgacgcaatggattatctgaacaatcaagctgtgtaaggcagtagtttttccggatattcaatgctcgtagtttatttccacggcaaaccaaacgttccaaccttggattttgagaaacatccaagtgcttcaacgcttgattaacacaatacaagtctattaatatcggacattgcgttacatccaacgctttcagtgtgcatgtctcgcaagcgtaatggaaagaggtgatagtatgagtttcatcacttctcaagcatatgtgccattctcccggctctgcatacgtatgctccgcacggacttcctcccctttttcattgttcatctcttctacctgcccatcaccccaatctatcgtgaacaggcaatcaccgtagcttatgaacgagaaactgtacgcagattgtggcttatttatagctacagtcatccgtatctcgtctttttgtgcgaacagaatcttcttcaagcggcggaatgaacggcggacggacaagatttcgtttttctcctcctctgaatcgtgctcatagatttttctgtcaataatttcacgatagcattcaaatgccttccataaatccttctgcgtgccgatgccctgctcatacatccgccccatattacaataacttcccgcctcttcgtaataatggaacgctttttcagcatcgggggcagtaccctcaccccgttcatacatttgtcccatcatgcgaggatattcgccaagctgataacatttcaaggctgtctcatattcttggcgtttgtaatgaatgtctccggcccaacatgctatcaatttaccgacttgcatccctatcttagtcaacatgtccaacgcttcctgattgcctttttctgctaaatcggacagcaagcgtgtagcatctgttccactatactcatgcttcttttcacattccgtttcataatccaataacagtaagaaccagtccgtatggagtaactcattttgcgtgagatgaaggacatccggtgctctgtccgggaaacggaaatgaatcatccacatgtgaagcaaatcatttgcagcatccctgtcaccctcctttgcaagatataccaacatctgcatggtgtcatttttctcatcatcggtggctgttcgagaatgcagcagattgtaaatcgaagtagaattagtagcacctaaccactctccgttttcagatgtctttacaaaataagacaacgatttgtgtaagtctgtgtgcaaggtaaatgtaggtgactgtttgattgttctcatccaagtatcccaacttccggggaaatacaattcaccaagtgcagccattgctttggcatacccttgtttggctgcttcttcataccagtagactactttttctatgcctgtatagtcttttttgtccatcatggcatcaaaaagcagttgccctaattgatattgtgcatttggattaccttcttgcgcaataggttcaagcaactttacggcttcttcagagtgtccattacgtgccaatttcttcaattgcttttgcaggcgtttgcttaccactttggtgcttttttccatgtccttccgatttttagttgtacaataggaaaaacaaaacctcatctttccatccatttcaatgcaaagatgaggtcaagttatgccaaagtggttcacaagttattctttcttcaatagtttgtcgatgttttctttgatgtcggcaagaatagtattataaagtgtccaatgaaaatcattggctttctcctctttgggcatatatcctggatgatgggtcaaatacgccaatttgacaccttcaatttgtaatttttccacatcatttgtggatagatcagaaatagcaactggctcacctatgatattaaagttctctttgatatagccacaatactttgtttctttgggtccagtaaggaatatgacaatatcaggtctcaatatttcaatttctttcggaataacatgaaaacatttcttttcaatgctatgctcaaacgcattgacagcttcccctccttctccttttcgtttagatagtttggaaatctcattccatattaatgaaactcgtttgtcggggaaatcctttaataactccctaatacctgacattattccattaacgccaaaaaggaggaatctatttctatggtctattttctctttataaaaatgtgcatctacagcattataattatcatcgagataatcttcatatgtagccataaccttgcctacatcggctgggtcttcacctttttcatcatatctcacccaccaattgggttccctcccaaagaacataatttttatgtctgctttggtataccactcttcatgctcagcatctgctttctttgtataccaattaatatctgcttcttgtgctttttctcgttcttccttttcttgcccagaacgatacaaagaaatcaagaacggacattgcagtttgtctcgtaacccattggcttccagttgttccattaatccgttccacttactttcgtaaagttcggtcaattgctctgataatgtttccataaacgtatattttaaagtggatgaattttaaaacaaatatagcgaattctctcaagaaaactttcattttcaatgagaaatgcaatatctgttgctgcaaagttctgtcaaggatatgtaacatcaaagcataagatgagaaaaaattgcagtaatgctttacattggcatcacttccattcatctttgcggaaaaaaggatgagaatatgggaaatagattttcgatagaagaactgacatgcctgcatttgttgcggtgtcactatgctgatatatgcggtaaagaggaacgggaattacgagaaacaatcgcccttcatccggcaaccttcgcaaaagcaaagatgatttgtgagaaagaaaaagaagcgaacatttgcattatcccttattatgcagacgattatccagtttcatttgctcaaattggcgtagaagcacctgcgttaattcatctattgggaaataaggagttactttataacgaaaattccattgccatcattggctcacgaaacactgatgatgtcggatgtaatatagcctatcaattggcaagagacaatgccttgaaagaaaatgtcatagtgagcggattggcattgggatgtgacagtgccgctcatcaaggatgtatagatgccaatggaaaaactattgcagtagttgcatccggtttgaatatcgtccaccctaaagcaaacgaattcttgcagcaagaaattatcgacaagggcggtttaatcatctctgaacaaccctttggcgtgaaagccaatcctgcacggctgtatgcccgcaaccgactgcaagcagccttagcacaaaaagtcattgtcgttcaatgcgcagtggaaagcggcacgatgaatacggtatattttgcacacaaatatggatgcaaggtttatgccgtagcatacggtcaatacgatgagcataatgccgggaatgagtatattctcaaaaatgggataagatttcctatcaaattatagaagttatgcactaatatggcatatcacaggctttattttgtaaccggaaactttaaaacagagcaatcatgacggtgaaagaattaatcatggaagtaggatttgacgacttgcttccttacttgaaagaaataatagtcgggcattttgacaatatctatgcctttcgggaagcatacgatattcttcgggatatgcagcctaatcctgagttcgttggaaaagtttggatagagcaagaagaggattggataagcatacagtctttagacgcggatttttgggagaatgaattggctaaagagcttgttttgcccccaaatactactctaagcaaagagaaaatagccgcgcattgtatatacgatattaccttttatggtttttctccagcagaaagaattgagaatttttggaaaagtcatgctcccatgcaaagcaaaatggaacgaaggaagtccatcatacaagaacttactgtgtctggaagcagtttcacgtacaaagatttggcttatctattgcaagtggagtacggtacacgatatgattatcattccattaccaacgggcaaggaaatcgattagcctatattgctgattccatgaccaaataccagcaacttgacctaagtcgatacaataatgctgtggtctgcattcgtgtttctgctcaatacccgttaaccaacaaggaactggacgattttaagtgtaatgtccgctcatggctgaattatgaagacattcaattgggcattataacaaaagatagtgattgtaaagaagcaacgaccacattgctattgaacaagcataaaaataaagcatagcaaagggaaggcttgcagttcattcgagtaaacagatgaaaataagaacaagtcaaaacaaattattttcttcattattttatgtttgatagcatttattctccatcccaaccgtcagtaatccgtcagtatataaaagtaaaaaggagctaagtcaacgacttaactccttcattttcaccagtcggggtgactggattcgaaccagcgaccacacgccccccagacgcgtactctaaccgggctgagctacaccccgaattgcggatgcaaaggtaaggctttattttaaactagcaaattatttgggatagttttttctacttttttaaggaagcacgttgcagcaaaatgtcagcttgggcggttatggttgaaaacaaaagagatagacttttgtctcagtattacctgaaacatgactgttcctgcaacggctccggctgtttatcccattgtttcgctatagaaatcaaacatatcatagatctcatcctgtgtagcagtttggttgatatgaacatcaccgatttctcccagcagggtaaagttgacgttacccagcgaagcatttttcttgtcgtgcttcatgaactcatacaaacggtcgtaatctttacagctgaaatccagtttcccgtaatgttctttgatgaactgtatggtttggcgcagtttgtctttcggaaaacctactttcagatgagaataatacagttcacagaccattccccaggctactgcatacccgtgcaatacaggatgttctgtttcgagggcaaaactctcgaatgcatgccctatggtatggccgaagttcagtgccttgcggattcctttttcaaacggatcttgttccacaaccttttcttttacttgaatggaagtatctaccagtttttgcaaatgcttgtagtctacatgttccagattgaaattgagaagttcactccagtgctctacattactgataagtccgtgtttcagcatttctgcatatcccgacaaaatattgggatgatcgagggttttcagaaactcacagtctatcagtacatagttggccggagcaaaggctccgatttcatttttcaatccattgaagttgatacctgtcttaccgcctaccgaagcatctaccatagccagcagggtagtcggaatattaatcatatcgataccccgtttgaaagtagccgcagcgaagccacccaagtcggtaaccatgccgccaccaagattaatcagcaatgaatggcgggtacctcccttgctgctcagttgattccatacataagcaagggtttccagatttttatgtatatcttctactccgatacatatctgttcggcatgagctaaaaacggatatttttcaataatgggaaggcaatacatgcgggtatgttcatcggtcaggatgaacactttatcgtaggattggctggaaactgcatgacgcagattttcttccagctcatgacaaatgacaacttcttgtttgctcataaatcttttgtttttcctgcaaaaatagaaaaaaagtaaaaagtacatgcccgtacgttgacaattaattatttttgtacagtatttaccaataaattgatttgtttatgaaaggaatattacccgttgcgtgtagatatgcaggctatgctttacttatcttatctgtttttgtacctttactgatgtacatgtttggacttgtacacgatggtaatttgttgtatgtcaagctatgtataaagcttgttatctggatttcactattcatgatctttttggcaaaggctaaggaagagaacgaagaaatagccagtattcgcagtaaggcgatgaagtatgccttatacttgtggggaatatactatattgttatgctggtaaagggaaccattaatcaggatgtgcagtctgccgataattctgtcggtatcgtatatatgattatcaatgtactttgctgggagtttttcttgcagaagcatcgtattgaaaaggcttttagaagaaaataacccttaaaaaaggttttgcaattaaacctttaaaatatttcaatgtcaaaccaacgttgaaacatttgtattagattgtaagaatgaaaaaatgggtgatggggttgctactgatatcctgtgggggagtcgcttttgcacaaagcagaggtagcaaaggtttggtttcgggaactgtcatcgataatgatgacaattctccggttatgcaggcaacggtgcagatacttgctgtgcgggatagttcaatggttacgggggatgtgacaaataatgacggacgttttgctttatctgtgcgtccgggaaagtatttgttgaaagtatcttttgtagggtatgcacctgcatttcaaccggtaacgctgacacagtcaaagccacgtatcaatttgggtacgattaaactgcattcggatgcgattatgctggaaggtgcggttgtagtagctcaggcgccggaggttacggcttcggaagatacgctggtatataatagctcagcctatcgtgtgccagagggatcggcactggaggaactcgttaaaaaattgccaggagctgaaattgatgaaagtgggaaaattaccatcaacggcaaggaaatcaataagattatgattgacggtaaagagttctttgccgacgatccgaatatcgcaatgaagaacttgccggtgaatatcattgataagatacgtgcttacgaaaagcagtcggatatggcccggatgacgggaatagacgatggagaggaggaaacggtactcgacctgactgtcaagcctggtatgaacaaaggatgggtaggtaatgtagacttggcggctggaacaaaagatcgttacagtggaaaggctatgataaattattttcaagggaaaagacagtttactgctattggttctttaaataatgtaaacgacaatagcttccctggtggtggaggtggctttcgcaaaggagataacgggctgacggctgtaaagatgggtggagtgaatttcgctactgaaacatcgaagttgaaaaccgaaggaagtgtgaaattcaattataaggatggagatataatcagcaagcaagcttctgaaacgtttgtatcgtcggagagcagttcattcaagaatgcgattgatcattctcgtaataaaacgactaacatgttggccgatgctttcatcgaatggaaaccggatactatgactacttttatcttccgtccgcgtatcagttatggtaagacggataattctaccagtcaaaattcgtataccttcggacaggatcctggctattctacggatgaattgtttggaacggatgatctgacctcgttggttcccgaagaaaatatcgtgaatacggttttgaaaaataccttgaaaaagggagatgatcttacggctggaggttctgcaatgattaatcgccgtttgggaaaggctggccgaaatataaccttccgtggcaaatataattataccaatagcagtagtgaacagttttctacctcacgaacagattatttccaaaaaactccggaagaacgtctggaaattttgaaccgttatataacgactcccactaaaacgtctgatgttagtgcacgactgacgtacagtgagcctatttttacgggtggttttcttcagttcagttataatttccagtataaacattctacaactgataactctacgttcaatatgggagatgactggacggtgaatgatggactgaacggtgatacacagggagaatacaacgcagatttaagtaaaaatgcagtatacaattattataatcaccagatggatgtaacgttccgctgggtgcgtgagaagatgagcctgaatgctggtcttagcttccaaccgcagaagtcggatttgtcgtataagaagggagaactggatacaatgaccgtgagaaatgtattcaactttactccgacgttcgatttccgatataagttctcaaaaaccagtcagttacgtattcgttatcgcggaaaggctgcccagccggacatggtagatttgttgccgatttcggataatacagacccgttgaatattcagaacggtaatccgggactgaagcctacgtttactaacgagctgcgcgccgaatataatttcttcaatacagaaaatcagcggggtatgttctcgttcttccgttatcagaatgtcttgaacgacatcagtaaccgaagagtatacgatccgcagacaggtggatatgtgactactcctgaaaacatcaacggaaactggaacttgatgggaatggttggtactaacattgctttgcgcaacaaaaaatatactatcaatacatttacccgggcaaattatcagaatatgatcagttacatcagcgataagaatgttgttgccgataccgacaaaaatactacgaagcgtttgtccttgggagaacgtttgagaggtacgtatcgtaatgactggtgggagttttcgctgaatggttcgctggattacacacattcacgtaacagctatcaggaaagcaataatatggatacgtatcagttttcttatggtgccagtacgaatgtgcgtttgccgtggaatatgtctatctctactgacttgtctcagaactcccgaagagggtatactgaatcgagcatgaataccgacgagctgatctggaatgcacagatttctcaggacttccttaaggggaatgctgctacggtaagcatacaattctacgatatcttgagaaaccagagcaacatcagccgtaccatcagtgctgccatgcgtcaggatacggaatataatgcaatctacagctattgcatggtacacttcatttaccgtctgaatttgtttggcggaaaggatgctcctaaaggtggtcctgggtttgggagaggaccaagaggtggatttggtgggcctcctcatcgtttctaaaatccttaaaaggatgatcccaaacgaaagactcttttcgttggagattgtgtaacctagaaagagatttcaggcgtaaatgattacacaccattaagttataggttgaagttgtaaaatataaaagagtcgtatcataaagtgcaccccaaaagttagacagaaaacttttggggtgcacttcaccgtttgggagtattgatacgactctttatttgtttttgtaaagctttcttgattttaattttaaggtttatttttaccccaattagggctctgtttgtttaattgttttctctatgtattggcgctataaatcaggcaagaggtattttactatcttttcttcttttttgcggaatcatttaattttcattatttttgtccgactcgctgaaaataatgttatgaaaaagcttttaaatatcctttcttttctgtttgttagtcttttagctcatgctcagctaaactgtacctttacgcattattcgcaggaaaacggtttgtcggaaaattcggttatggatatggtgcaagaccatgacggaatgatatggtttgctacttgggatggcattaatcgtttcaatggttatgactttaaagtttataaggctcgtaaggaaaatgatatgctttggagttccaatcgtgtagatcacttacaggtggataagcaaggagatgtatggtgcattacttacgatggcagggcgtttcgctttgataagcggatggaaacttttaccgaagtacctgccgatggtataggaaaggaactggttattaattctatcttgccactcggtaatggaacggtgtggttgcttactgatagaaatggaggtatcagagtggtacctgataaaaaaacgggaaaatttacttccaaaatctatctgtcgactacaaacaaggagaaaggaattgccatcaatactatttatctggatgcgaataacagggaatggttgctgacgcaagatgggttatttgcaatagatggtgaaagtggaaaaagatcttctttttttgtacatacgcggcttgaggctggtcatatgggacaatcttttttttcggcaacttctgtgaacgaacacgtttatttcacttccagttacggacgagtttggaagtactcgttgaaagatgcttctttcgagttgaaagaattatcggtgaaagatgatattatagccattcaccagttgtcgggcaataagcttataatggctacccgtacatcgggctttatagtgggcaatgcagcactggatagcctgacatattataatccggtcgataaatttgatttcgtacagtatccgatacggtctatgtatgttgatagttgccatgaggtatggtttgaagtaaaaaagattggtagtgtctgccatttcaatccgtttactcaaacattcaaggtagaacagattgcggtggagcaggaacctggcaatgcacccaagtttgccatttgtgaagacggtcagggaaatttgtgggtacatccgggaggaggaggtttgtcgtggtttgatcggaaaaataaccgtctgcagcctttttataatgaggccggtaccgattcatggcgcttttccaataagttgcatgccatgatgcttgaccatcagggtaacttatggttgggaacgcactccaagggactggataaagtaacgttctttaaaaataaatttcgtttgtttaagcctttcgattgtaattatgataccaatgccaatcaggtacgagccttgtgcgaggattcccggaagcagctttggattggtacacgcgacagcaaaatctcggtttattcactcgactttcattttcagggttatctcactactgatggacggatttctacttcaggaacaccttttaaaggatcggcctataaaataatagaagattcacataagcatatctggattgctactaaggggaatggattgcttcagctcattcctcagggaaacacatacaaagtgaatcattatgtatataatgccagcaatatttacagcctgagtcataacagtgtttacgatttgtgtgaagatagctttggacgtatctgggtcgttacgtttggcggaggcatcaactatatagaaagacaaggcgatggcagcgtacgctttattaactcgcacaataacctgaaatcgtatccgatagaacgttgttataaggtgcgccgtatacgtcaggacggacagggaaccttgtgggtagcaacttccaacggattgttgtcgttcagtgagaaatttacacgacctgatgatataaattttcatttgtacgtcagtacgcctggtcagcaggaaactttgacttgtaacgatatatacgatattttgcttacgcacgatagacaactgttttttgctacgtttggtggtgggttgaatgaactgacacatatcgacaatctgggtaatgcacggtttgtttcgtatggtaccaaggatggccttcctacggacgtactattctcgcttgccgaagacaaggaaggtaacatttggatgggttcggaaagcggattgagtaggatgaataaggcaaaacatcattttgacaatttcctgaagcaggaaattggtgaggagttgctattcgaggaaagtacggcgattgcttcgactgatggacgtctgctgtttggaacaaacagaggactcttatcctttgtaccaggacatatccgaaaaaatgcttatattcctgagattgttttttctggtttgaagatagacaatcaagtgattgttccaaaacccggttctgttttgccggagtccttaaactgcttgtcgcatcttacgctctctcataaagagaataccgtaacgttatcgtttgcagcactagatatgagttttcccgaaaatgtgaagtatgcgtatatactcgagggcttcgacaaagagtggaactatgtaggtaaacagcgtacggctacgtataccaatctgcctaagggagattatgtgttccgtgtcaaatcgaccaatggggcaggtatctgggtggagaacgaacatacgctgaatattactgtaaagccctcgttttgggaaacgccttacgcttatgccctatatgtactggtgtttatatttgttctattgggaggagcttatattctgttcttgatttatcgcctgaagcatgaggtatctgttgagcagcaggttacagatatgaagttacgtttcttcaccaatatttcacacgagctccgcacgccacttacactgatagaaggaccgctggaatatatcttgaaacgtgcggatttaagcaaggaagtacgtgagcaattgcaggtggtagaacgtaatactcaccgcatgctgaggctggtcaatcagattctggatttccgtaagatacagaaccataagatgaaactttcggtcgagcagattgatatcgtatcgtttgtacacaatattatggaaaattttgaatcggtggcagaatcgaatgagattgattttttattcgagagtgagcaaccggaattgaaattatgggtcgatgccgataaagtagagaaaattgtgttcaatctcttgtcgaatgcatttaagtatacacagccggggaaaaccattaccgtatttgtacacgataatgaaaaaagcgtaacagtaggcgtacaggatcagggaatcggtattccggaaaacaagaaaaattctttgtttgtgcgttttgaaacgttgctcgacaagaatttgttcaatccgaatagttcgggcatcgggctttcacttgtgaaagagctggtggaaatgcatcacgctaccatacgtgtagaaagtaaagtaggagagggaagttgctttatggtagattttctgaaggggaaagaacattatggcgaagatgtagaatttgtcttgtccgataatgtagaagtagtagatgctattagcaagcaggaaacgccggatggtgtggtgaccgttgcagagacttccacatctgggagtgctccctctgaaacttcttttgaaaagaccatgcttcttgtcgaagacaacctggaactgaggttcttcttacgcagcatattcagctctcgttttcgtatcatagaagctgccaatggggtggaaggtatggaaaaagcagtgaagtatatccccgatatcattatcagcgatatcatgatgcccgaaaaagatggtattacactggtccgtgaattgcgagaggatttgactaccagtcatatacctatagtgctgcttacagcgaagactgatatcgataccaagctccagagcttgaaattaggtgccgacagttatattactaagccttttagtgccacttaccttgaggctcgtgtggacaatctgctggcacgtcgtcagaaactacgtcagttctattgtgagcacttaatggatcctgattctcctgaggtaaccaatgaagaagaggaagtagacatgatgtcgcagcaggatcggcggtttctagaccagctgacagagtttatggagcgtaacatcgacaacggagatctggtgattgatgatctggtgcatgagatggcagtaagtcgttcagtctttttcaaaaaattgaagtcgctgacgggacttgctccgatagaatttgtcaaagagatgcgtgtaaagcgtgctgctcagcttattgagacgggagagttcaatatgactcagatctcgtacatggtaggtatcaacgatccgcgttattttagcaaatgtttcaagcagcgtttcggtatgacacctaccgaatataaggaaaaacggaaaaaatagatactggattgttttttattggtaagttttttaaatgtcattttagcaacgatgaacaattaatctgaaaagtttatatatttattaagagataaagaaaaagagatcgtctcaaaatagaattgcaaaagtaaaaatcttatagattgcaacttagaagtaaaaaatctcctacttttagtcctgtaattaaagaaaacaaagactgaagtaggagatttttatgttgtaacttatagattataagtaagcctgtctcagcttttcattttgatacagcctcttcttagattttgtagttgtaggctattatttgttgatctgtcatttaaccatattgtatgcggtatctgttgggctttagaatggatatccgatagcaaaatgaatacccatgccgtctttgaaccggggaatgttgtaatacttggagatacccgtttcgtaaggtacgtgaagggcgattccccagtcgaggcggagcacgaggaatgacaggtcgtagcggatgcccaaaccggtgcctagtgcaatgctatcaaagaatttgttgaagctgaattcggcatccggacgggcttcatccttgcgcatcagccatacgttgccggcatccagaaagacggctccgttcaggttgccgccgaacaagctcgataggatacggaaacggtactccagattggcttccagcttaatgtcacctgtttcgtcgacgtacgaataggtggagttttctgccggatggaaacgacccggaccgatggaacgtaccgtaaaagcacgaatgctgttggcacctcctacgtagaactgttcgctgtagggagcgatggtcttgtttccgtacgaccaaataactccagccatgaagcgggcagctatctgctgtttgtcgctgatgtaatacaacgggcgtatctcgcttgagattttcagaaactgtgcaaaaggagtccctaaaaatttcttatctttttcttttaggcttcgtccgaaggctgcataaataagggaggtgacgtttcctgccgaggtaaaggagttttcccaccacaggcgcatccggcgctgctgccaggagttgtcgtaggtaaaggtataggtcaccgatgggatgaactggtcgtccagactgtagaacagcatcgggttggcttctgctatggagtcgaaggctgccgtacggtgttgcaggtggttgaatgccagatgaagcggcgtgacagtgtgcttcatgctgcgtgagggctggaagctgtacgctacgcttccgccgaaggaaagcatcttgaagtaacgggcacgattcacttgttcggcataaatcttaaagttggtttgcgaagggaaacggaaagggtcgatacggttacgtacccacggcagtacgaggcggggaaactccagcgacaatgccgctcctagttcataggagttcatgaccgacttgtcgccgtctacggtagaactcgtttgccattcatacgaaccctttagctcgaggttaagcgaggctcccatgccgcggaagttcttgcgcgagagattgaaaatggctcccggtccggtctgtttggtacttttggtcgtgacgttcagttccagttcactattgtagggcaggtcgaacatggcatttacccgtatgtcgagggtatctttttcggctccgctacggggagtgtattgaaagtcgctgaacttgaatacgtccagtcgtgccagtgcttcttgcgtatagttctgccgggtttgtgaatagacttctcctttgcggtataggaaacgcttgcgaagtacgccgtaccggatgccgggcttcttgccggaataataaaccgtaaagttgcgtcgtttcagcgaatcggtgggctgttcgccgttgtagccggtaagatacaccgaggtgtgtccgatgtaataggtgcggagtgcttcttcgggtatgctctgtcgtggtacaatcttcatgctgacgtagcctttgcgcatgatggtgtcggccagaaacgtcagaaattcgtttcgggcatagtaatatccgttgtctcgcagcaagtctatcaggcgttggcgttcctgatttagcacggtcacgtcgaagttgtcgccgctgcgtaccagacgttcatcgaagtgggcgcggatcagactgtcggtacgtggccggaagccttcgtagatgagagtatcgatatagtagggcttacccatgtcgatatcgtagctcagttttacggcacggggattgcgcgtgctgtctacacggtaggttaccttgccgtcaaaataaccgtagtcgtgcagcaggttggttgctaccttgatacgagtttcaggattgacggtagaaacgtatacggggtcggaggccagttttttgaatacccaatggccaaatcctttttcatatcgctcgaagcggttgtatatccatagtccgaaggggatcggaaagcgtatgttgggattgattgtaatggcatagttgggggcgatgctgattgcaccttccacttctgccagcgcgttttgtcctgccttgcttttgtcttcgttgttgatggttacctttttcaatcctaaatacaatgtttccccttcaggcaaatgcttggtagtagagcatgacgctgagagtaacgttaccagcagaatggctatataatatatgttctgtcttttcatgaatctgtttttatgtgtctaaaaaatcagttggctgtttcttgttccggctgcttcttctttcgcgagcggaagatgaagagctcacccagtttgcttactttctttctcagtacaataccggcaccggtttctatcacttcgccgtcgagaatactctcgtaattcttgtcgtggaaaatcttgatgtagcgtgttccactgttgtcgaggcggtattccagcgatatattatcgataaatgattcatcttgctgctgtacgtcgtttccggtcgaaatctttccgccgataattacctggaagcggttgttccagaaacgtttggcaaactggaagttgtagtcggtacgggtatttccggtaccgctttcgtccgtggtttccataccgaaattgatatcgatacttttcagtgcgcttcccgccactttgttgatttcgctttgcaggaaagagttcagcatactgttggtatcgaatcctttcgttccggcactgctgtcgcccatgtatacgccggttaccagcatggtgactgccagcttgttcttttcttcagccgactttgatgccagttcattctgcatggttccgtcgtcgggggcctcgaggataaaggtgaatcctagattctccaagcggttagtcagattaacacccacatcaaagttaaccatacgagtactttctcccccgtcggatgaaaccgaggcgcgtacacgctcggaggctttgatgttcagattaggattcatcaagttaccagtccattctatgtagcttccgtcttgtatgtagaaggttttcagtgggataataggcatttcgtatttcatttctccgctcatcagcgagtaccgtccgttcagcagcatgttgccgtcgggttgatactggaacgagaggtcgcctccaccttccagcagcatgtagttgctgccgttgtcgttcaggtcgacacgtgcctgtacggcttcatcaatgtggagtgtcatcaagatatccattcctcccagcgacataaccggcatgttgggcttctctatatgggtggtatcgctgaagtcgacaaacgttacggtttcgttcaggcggtcttccacggtgagcggtgaatctttcagcacataggtgaaatcactgttgcctagtatgttcatgtttccgcgcatggtcaaggcatctggtcttccttttagcatggcgttgacatcgacatacagtttgccgtgaaccagcgattccttggtgcgcttggcattgatcagttcgaaattatgtgcctgcatcttcaggttgatatccatggcagccatgtcggtcatatcgacatatccgtcgatgctgaacggcgtttttcccttggtgaagatattgaagcgttcgaatatcaaccggctgttttctatcttcagcgggcggtcatcgaaacgaaggttcagcgaagcctgcggtatgtttacgatgacgctatccattcccaattgtccgtttaatacgggttgcgacgtagagccttctacggaaatggctccgtcgaggtcgccttgcagctttgccatattgtcggggataaatgcattggctatcttcagcggcaggtgatgcaggttcacgtcggcagtgatatggtctttgtcgtttttgtccgaagccgacagataacttccgttcatgctcatgatttcttctccgttcagcatgacaaaaccgtcgatgctgtgctctcccgtttccttaggaagatagacggcgctcatttcccagttgcccaatggctgcttgttgtaggccagattgttgatacctatatcggtagctacttgcgtagtggcttcggtctgtatataatgggcttctgcattgatgaacccggctatgtcgggcatgtaagggataatgcgccggaattcagctatgtttatctggttgagtcctaacgtaatatcttgttgagcgagagaatcgggggtagagtacagcgacagtcccgaatggttctcgtcgtatatctttacgtcggcatggatgcgtccctggtcgctcaggtaaatgtaattgtcggggtttaccttgaacggccggtataccagtgtgggggtgtcgggagtaatgtgcatgctgattccgttgggacgtagctgggcttgcaggccgaggtctacgcctgtttctcctttcccgtttagataaccgattagcatctgtgcgtcggtagaacctatgtaaccgttcagagatatattgaatgcttcctgacgcttgctggcaagtgcctttacaccgctgttgaactgtaggcgagcagaatcctgtgaggccctgaagtaaatagtgtccagttgcagactgtcagtatgcaggccaaacaagtcgatagaaccgtccagtcctttttcgggtgacatgctgaagtttgctctcaggcggttataactgatgtgctgtgctgccagaaaattggcaaccggattgtcggaaccggagaatatcttcagctgggctgtcggcattatctccttgagcagttgctggttgatatgtttctttttccactgagcactgaattcttgtgctatgcggtcggttttgttcatgaatttttcgagactgttcgctgttcggaacaggaaagtcaggtcaccggcattcacatatcctcgtaccgagtcgggcgccatgttgaatccagcatgcaggtccttggtcttgaatgtccgttccgccgtggccagctggattccgctgatggttgtccgtgcactgtgccgctgtttcatgtcggtctgtgcatgaacttcaatgttcatggacgagcggaacggcgtattcatcagtgccagttcctgccagtccagcaaccggatgctagtattgagatcggcttttaccagattgggatgcaacaatgcctgcaattccgccgatacgtcgagcgcatggttgttgatgttcagcagtgccgaagcttgagaacgttgcagtcctgccgtcaatgtcactcccgagaatacgagtgacccgtatcggaagtgagaaacttcggtttttagcattgctcttgtacgcggagagaaaaagtccatgccttcgccttcagcatgaatggtagccgaaagtccgaagatggagtcatgaggcatgaaacggtgcaggttgaggctgtctacgttcaggtcgaacagataggcttccttctgcatgtcgtagtctgctttgacagatacgttggccttcctgcctggcaggaattgtaagtcggctcccagtctgcttccgttgattcgcgcttccccgttcaacttcatgccgtgaggcagcacgataccttccatcatggtttcaacgaaagccagattgcccgtttctacctccaggttgaccgaaccattccggcgtatgctgtccagtggcagagaaatttttcccgacgcctgtgccttgagtgctccctgaatgtttgccgagagtgtagtgaggcgtatctctttcaggttgccgtctactcctgcccgtatttgtaggggagcagccggatatttctggatgaacgcttcaggcatgctggtaacgaccttcaacaagtcgttcttgccgatgtctgccatgaggcgggcgttgatttgtccgtccttatcggcatgcgtagcatcccagtccatagaggcgttaaactcgatgaacgagtcgggagtctttatctggagcgagggtaccttgagggttttcgcgtcggagattagtttaccttgcgttgaggttatttccagtccggaacgttcctttaggttgaagtctttgatattggcatagatatcctccccggcataatataccgagtctagacgtaggttaatgtcggtgatggcgatatgtgctacgtccagtccctgtgcgggagcaagcgtattagtattgatggaggccgtacctttgttcagattgagtgtctgggcagagtatgccgatttatgcaaatctaccagtccgttgcgcagtgacagctttccgatggacgctgacatgtcgagggagtctaaaggcatctgcatggcaaacgatacattttccaaatcgacatttttcaggtgtattttccagtacagcggtgccgagctggtcgtgtcggcagcagtcgtatctgccatgcataccgacaggtgtgtatctttcagcgacagtgtattgacaatggcagtttccgggtcgaggtctactccgtgagaggaaacgaagagttctcccagattgcctttcagggtgagaccctcaatcaggtttgctgtattgaccgaagccttggtaagttgcagtccgtccagctctactttcttccgtaggagcggcatgagctgtaccttggcagtcagccgttcggcattcagaattgtgtcctgcttgtcgactacaaccgtatggttgactaccaggtctaaggggaaggagagcgaaatccgtccgatggaaatttgcattcctgtggcctcggaagcataacgggtagccgtattcaccagaaagttctggataggaggaatgtatatcaaaatgcatagtagtataaatagtatgaacggtgatgcgacggcaatcccagtccatcgtaaatactttttcataggctaaataaagcgtatagtttattgcgaatttatataaaataaccgaaacaacattcattttgttctataacaatttagcgccatttatataaattctttacctttgcggtataacttaatttaaagacatattatgaaaccaactttatttgtcctggcagcaggaatgggaagccgttacggaggtttgaagcagcttgacggcgtgggacctaacggtgaaacaatcatggattattctattttcgacgctatccgtggcggatttgggaaaatcgtatttgtaatcagaaaggattttgaagaggatttccgtaagaaaatcatcagcaagtacgaaaatcatattccggtggaagtagttttccagagcatagacaagttgcccgaaggattcacttgcccggcagagcgtaccaaaccatggggtaccaatcatgctgtgctgatgggtaaagatgtgattcgtgaaccttttgctgttatcaatgccgacgacttctacggacgcgacagtttcgccgttatcggcaaatatctgtctgaactacccgaaggagccaagaatacatactgcatggtaggattccgtgtaggtaatacgttgagcgatagtggtacagtagctcgcggtatctgctctaccgatgaacacaggcacctgactacggtagttgaacgtactgaaatcatgcgtatcaacggcgttgtttcttataaggacgagaacggtgaatgggtaggcatcgaagataatacaccggtttctatgaatatgtggggctttactcccgactatttcaagtattctgaagattattttgtagacttcctgaaagagaatattgacaagccgaaagctgaatattatattccgctcatggtgaacaagttgatcaacgaaggtactgccacagtagaagtacttgatacgacttctcgttggttcggtgtgacttatgctgccgatcgtcagggagttgtagataagctgaaagcacttgccgactctggagaatatccgagcaagttgttctgataagtgaaaaattcctttgtgctgaaggatggattttaccgttctgttcagcataaaggaatttttttattgcaatttaaaagattattcgtgattttgcgaacgataagaaacgatggaagagaaaaaggattatacagccacacaagagcagttggcaagatttgccaaagctttgggacatccggcacggattgctatcctgcattttcttgcccggcaggaaacatgctattttggtgatattcatgaggaattgcctattgccaaggctaccgtatctcaacatttaaaggagctgaaggatgcgggacttatacaaggtgaggtggaaactccgaaggtgaagtactgcataaaccgtgaaaactggaaactggccagcgggctttttcaggagtttttcgggcagtgtgtggagaaaacgaaaaagtgctgtaaataataatggcctttttggattgtgatgttatggctttgtgaattaacactaaatttagtgctttagaaattaaagctttaggaacagaatgttcctcgatgaagccggaatatccacttccaaaggaggtggtagggctttcactttccgaggcaaaagtgattcagtagaaacttcaggcgactgatcaggtgacataatcccaaaatgctgaataaaatacctacctgatagtgtaataggccccaatgtatatctgcgggacctttttgcaatatgagaataatggcagtgacgattgtcagcaagtaggccaccgatagtcccattgtgattttgctgtggcatttggtgcctctgaccagacttttgtaccatctccaatgcgctttgatgtgcaggagggaagctgtgaaaaacaagattccgaatagggtatgcaatgctgtccataattggcctccctgctgtacgattccatggtccgcggcgtgcataatcagtcccgtagcgagtattatcggccatagaaccgccagtgtcaagtctgttgaaaatacgattcttttattcatattgttgtcttttggtgattgttgattcatgcatgctttgaggcatttcatgcagcctatacatttttcggcatgtttgattactgcgtgccggtgtgttaagagctgtacatccaatgtttttacgcagacaaagttaaggagaggaagtgatggcggcaatggagaactgttgttggggagataagcagatgagttgcgatgtcagggtatattgttcgaaagccctttgagaggtttcttccacaaaagcgctgtctatcatgagcaggtacgccgacagctggtcagagtgtgtaaaacagtgtacttgtccgggcaagaccagagccgttttgttcaccgccagttcatagtccttgaagtcgatgcggatattgcaagtccccgattcaataaatccgaatatataataatcgtcttgatgtacatagttgaccggtgtttctcgtatgttgtccggagagaatagccgcaggcgtattcctgtttcagaaatgtcggaaactctatgtctgggcagtctggtcattaaaaagctgttttacgggattgttatggattatttgataagcattacaatgcttccgcaggtaatcaggagagcccctattattactcgcaggctgaccggttcgcgcagaaacaagaacgacaggcagatggtcatgaccacgctgagcttatctatcggagccacacgcgacacatctccggtttgcaatgctttgaaataaaacagccacgacagtcccgttgctattcctgagaggatgaggaatatccacgtatgttcactcacttgtctgatgcctgcggtttcccggctgcagaaaacgattccccacgtaatacacaagataatcgtggtgcggatagctgtagcaaggtctgaattgatgtcttttacgcctatcttggcaaagatagctgtcagtgcggcaaaaaacgccgacagcagtgcataatacttccacataatcggtcgaatttcttaaagtacgggcaaagttattgttttatgccgaatgatgataccgagaagtgaaaaaatagctgtatgaaataaacttgtaagagaatattttaataagttgaataggttatagaggtcgacggggttctcagctttttatattgattcttcttttttattcaggctggctaaaatttatgcttaatcaatgaaaccctcaggcttttacgttgagccgacatggaatggagggaaagatgggggaatatctgtgtgcaggaggtatggatattttatcgctaatatgcttcccttgtgggaaaggtccttctgttatctccgtacaagtgttttcagccgaaagacagaagaagatataagaaggcattttgtcaattggatagcagacaaaggtagggtagcctgagtgcggaaaaacggaaggccatgcggcatacgggccttgtgttgtccgatgattcagaaacccggcacaatggcgaggacttattcctcggtgcctttctgttttggcatacccggtgccgaagacgctcttgttaccgaacttgaagaggtgatgcaccatatagtgggatggcttcccgaatatgggaaagtagtcggtttgctgaccgacaatcagggtaagggactttttccttttatcttcaggctttccttgcgcaaggtgttctcccgttttcatgctacggaattatgcgacgaagtaaactatcgtcatgcactccggcagcgtttcattgttatagacgatttcgatatagaaagaacattcaatgattatggcaatcttacgtggctttttctgaaatcgttaacggcatcgagcggcgggtactttgcttatagccaataccaacctgacgatggaggaaatcaaggctaaatacggtctccgtacttttgaccgtctgcgagtcaatatgcaggtggttgtcattcggaaaaggtcagtattaaagtttttttaacctatgattagtttctgattgttatgtaagtgatgattcggaattttttttcattctttgaatgcatgatttagcttttaaatatctgaatttaatgctaattgattatttttgtaagacaatgtatatacaatcataaaaatatagaagtagttatgtcatacatatcaagtgaaggacttagttggagaggggttttgaaaggatttcccaaagctacaaatattatgcaaccattgtttgaggcttttacgaatagtcttgaagctattgatatgcgtaaaaggcaggatgatacttttttaccttatattcatttagatttttatttcaatcaaacaacagataatgaaaatgatggcttgattcgcttttctattacagataatggtgtcggttttgatgatgagaattttaatcgtttaaaagtatttaaggacgattcaaagggtgatggcaacaaaggttctggtcgcatacagtttatacaattttttattactgcaacctatgaaagtatatacagacaagatggaacatataaattaagaagatttgttttatctaaggctgaaccttttttgcgacaaaattctattttacgtcttgatgaagaacgcgaacttgataataactctgagctaaaaaccacattattgcttgataatttaagggcaaaagttgatgtgaaattttttaatagtttaggaatcaatgatataaaagaggctttattggaccattacattctatatttttgtgtaaataggactcatttacccgaaatagttataaattattatcatgggacaaatttaatagcaacacgaagaatagatactgaagatattcctaaagtatcgcatgaggatgaaacgattaatgtccctttaagtcaaatttcttctgatatgaagagggtggaaacttctatagagaatatagaggtaaaaattaagtcgtttagattaccttatggacagttgaagaaaaattcagtgaaaattacttgtaaaggagaagttgttgattctgtaaaagttaaacttgattgtttgcctttggatatgcaaataggaacttctgtcttcttgttcttgctatctagtaagtattttgatgaccgtattggagatagccgtgatacattagaaattctaaatagaacagaattcaaaaaaagagctaaacagtatggccgaattgacccacaaattgtaatggatgatttacaagttaaagtcagtgttaaagcagaagaaatgtatcctgagataagtaaacagaaagaaatacatattgaacaattagctgcgctgaagaaaacatatttgttgtcagaagaggctttggctgaatctgatgtaaatgacagtgttgaagatattttaaagaaagcatatatttatgatgcgaaattaattgcagaacgtgatgctgcatatcattctatgttggaacgattgaatcagttagacactagtgctcctgcatatcgaactgatttagaaaaacttgttgctgaaatgactaaagcgattcctttgcaggataaagaatctctgtcaaggtatgttactcatcgtaagcttgttcttgatttgatggcaaagattttgcgtcgtgaaacaagctatcaaaatatagagggcactcggaatatagatgaaaaattacttcatagtttactttttactcaacattcggatgatgtgtgtaatagtgacctatggatgttgaatgaagattatttgtatttcagaggtgtatctgaccagcctttaaatcagatagaaattgatggtataaaattgttcagagaagaagttacggaggaagaagagcgttatttgtcatcattgggtgagaatagacgtatcaagagaccggacattttattattcccttcagagcggaaatgtattatagtagagctgaaaacccctgagaccaatttggctttacatattaatcaaataaagagatatgctaatttgcttcgaaactttacttctgatagttttatgatagatacattttatggctatcttataggagaggctttagaacctagagatataagagctgtagatggtaattttaagtatgatccgaagttcaattttatgtatctgccttctacacctattgtatatgaaaacgatcctacaggaagacaagatggtagtttgtatatggaagtaatttcttattctgaaattctgagaagagcagaaaaacgaaatgaagcatttatatctaaattgtttcctcaaaaagttgatagcgaaggataaaacacctaacaaaagaattccgagttaacagaaatatattatatattgttttgattattaaaatattatgcccacgcttgattggattggaaaagaaaaagtaatcaatcatcatcacgatgtcccttttcgtgtattagaacataagtatggtttccgagccgataacttggaggataagtctgaaacccgtagcggtaataaaatcatccatggagataatcttgaggctttgaaggctttattgccggaatatgaaggcaagattgattgtatctatatagatccaccatataataccggcaatgagggatgggtatataatgataatgtaaatgatcctcatataaaaaaatggttaggagaagttgttggagcagaaggtgaagatttttctcgtcatgataaatggctttgtatgatgtatcctcgattgaaattactacatcaattgttggcgtcagatggtattatagcagtttctatcaatgatcaagaattgtttaatttgggctacatcatgaatgagatcttcggtgtttcaaatagattggcttgtgctccatggaaagcagaacctagtggtggtaaagataaaactgcattaagaacaggccatgaatatgtgttgatttattcaaaaggtgatactaaaaatttagttaaagaggaaaaaagtactggaaaattagataaaaaagataaatggggaagatttagaaaaggtcgtgaattgagaaaatggggagcaacttcggatagaaaagacagagagaacttgtggtttgaaataaaagctcctaatggagaatttgttgttcctatcaagaatgatgggactgaaggatattggcgatggggaaagacgcatcctattatgaaacagattctagaaaaccctgagtatgcttattgggaagtttgtccatatgataaagatgttgtagtagatggaaagacagaacgtttagtcccttttgagaaaatacgtgaagaaaaacgttcttttggatggaatacgtggctggattcttatggtactaattctgatgcaacaaaagaaataaagactatatttgggagtaaaatttttgatacccctaagcctgtaagtttagtggaatggctaatctcattacatggagatgaagatggtattgttttggatagtttcgcgggttctggagtgacaggacatgcagttttggctctaaataagcgtgaaaatacaaatcgaaaatttattcttatcgaattagaagattatgcagagagtattacggctgaacgaatgaagcgggtaatgattggttccgagcaaatacctagtttgggaggggctttcgattattacgaacttggtgcacctttattcaacgaagatgataccttgaatgaagaagtcggagaaaaacgaattcgtgaatacatttattatacagaaactcgtgaatatctgacaagagaacagagcgaagaatatccgtatttattggattatcatgatggtacaggttacttcttctattataaaaagaatgaattgacaacgctttcacatgatacacttaacattgtaccggagaaggcagactattatgtaatttatgctgatacatgtactcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtgtactatcagtagagaacaattagctaaaatgaatatatcatttaagaaaattccacgtgatataaatagattttaagtatggaactgaagaaatatcaagaagatacattaagagatcttgctcaatatattgacgtgttaaatgggtgtaacagtctttcggtagcttattctagatattgggaacagaaaggtgtgtctgtctgtggaataaataatgattatttacgaccttatatcaatagtatcaattctgtacctcgtgtaacattaaaagttccaaccgcaggtggaaagacgtttattgcttgtaatgctataaagactattatggagcgtttacaaacggatgctccaaacagggttgtagcatggtttgttccgagtgatacaatcttgaaacaaacattggaaaaattacaagatgtagaacatccgtaccgtcaacgtttggatgcattgtttaatcatcgtgtgatagtggttgataaggaatcggctcttatgggacaagatattagccctacgagtatgcaagaaaatttgattgtttttgtacttagtgctcagtcatttgtagaaactattcgggcaaaaaacaataagacatcggaacaggcaaagccacgggtctatcgcgaaaatggaaacttggttgaacatgcaaagctttatgttaatcctgacaggttgattgaaggcactgacccaacagcacttatacaggtgattgcccaacagaatccgctcgtgattgtagatgagagtcataattttaaagctgatttacgagtggaaatgttgactaatattgcaccacgttttatactggaattgaccgcaacaccacgagaaaatagcaatattatttcttttgtagatgccatgcaattgaaaaaggagaatatggttaaactgcctgttatcgtggaaaatcgtaattcagccaaagatgtattggttaatgctatacgcatgcgaaatagtcttgaagagcatgctaaaataatgaaacagcaaggaggtaaatatattcgacctatcgtgctgtttcaggcacagcctaaaacagatgacgacaatattacgttcgacaaaataaaacagaacctgataaacttaggtattcccgaggaagaaataaagataaaaacggccaataaagatgaattgaaaggtataaatctgatgagtgatcaatgtctagtcagatacatcatcacagtaaatgctttgaaagaaggttgggattgtccgtttgcctatatattggctacattagccaataaaacgtctgctgtagatgttgagcagatattgggacgtattctgcgtcaaccttatgcaacaagacattctaacgagcttctgaacatatcatatgtgtttacctgttcaaatgatttccgccagacggtagagaagattattatgtcgttgcaaaaagcaggcttcagcagaaaagactttagagaaatagaaaaggtcattcctcaacagcagcatcctgtaacaaggggaaatttgtttgaaaacatggaacttaatgatatagaaacagaagataatcctatggacatgacggatgaagaagttgaatctatcaaggctgaacttcatgtaccagggacaaacactgaaattgcaacccttcaagaacaagctaagcaattaagcaaagaatacgataagcaaatagatgataattctaattataatgatcctttagctggaattatgcctatggataaatattacaaaataaatgtagagtatcagaaagtggcttcagaaatgatattacccattttttatactaaaacaagtgcttccgtattttcagaagaagaatggattccattggaaaaatctatgctgacaaagggatttgacttgtcaaccaaggataccttcgtggattttactataatacgccctcagggaactactattgatattgctgggagtggtgatagttatgttcctgtcaggaggaataatcaacagtttattgatttgattcgtagtcaatatgtggataagtccgcctctgataaaaaagggttattggcgaaacaaatagcgcgtttaataaagatagacagtatccctgagcctcgtataaaggagtatgtatctagagtgatagagcgatttaatgctgatgaaatcaataacctgataagcaatatttataatacgagggatgcgattcagaataaaatagaagctttgttgaaagaacatcaagctgaaactttttattattggcttgatatatcacgtatagaagtgcggcctcattatactttcctagacaaagtcgtttttacgggtaaggagcttcaaggattagaaaaagggttatatgcaaaagaagaaaacgtaaacgactttgagtatgatgttatttcggccattgctgataacaataatgtgcttttttggcatagaaattcagaccgtaaggggttttgtttgaatggatttatcaatcattatccggattttatagtgcgtatgaaatcgggaaggaccattcttgtagaaactaagggtgaccatttggtgaatgatgattcattaaataaaataaagattggccgaaagtgggcagatatgtctggtcctaattatcgatattttatggtttttgaaaccaaagaagttgaaggcgcaataacagtgaaacagttattgcaatatttgaacgagctgtagtactaaataatagcaagcgatggttataaaaagaaataacaatttgaaaaggaaacggactgtgaaatcaagcatgggttttgacttaaaagttgttatgtaatatttactgaatgtccctaagaaaacactgaaaaatagcaataaaaaatggcatacgaagatggtagaccataatcacttcgtatgccattttattttgaggacatttactgaatatccctaaaatttatgcttaatcaatgaatccctcagttttttacgttgatccttgatccatccttgagcaatttttaattcctgaaaatccccaaaaaagaaaagggactcaattgagtcccttcttttggtgatccgcttggggctcgaacccaagaccccaacattaaaagtgttgtgctctacctgctgagctagcgaatcaaacctgttttgctatcatttcctgattgcgagtgcaaaggtaggtgtttctttttaaactgccaaatattttggaataaaatctgaaaataatattttgtttaatttgtataatgttgattatcagtaaactattttatagtgttgaagaaaaagaatatttaagaacaaacttaataatcgtcaaaagcttaaaaaggattgttttattcttgtttttttacttacttttggcaaagtatttgtatgattttaagtgaatcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattggtgaatagaaacacataaagatagattgtatgtattggattttatttattggcattgcccttatcagttattgggtgcagtcgaacctgcaaagcaaatttgatagatattctcgtatggcattgagtaatggcatgacgggcagggagattgcagaaaagatgcttcgtgataatggcatttatgatgtaaaagtaaccagcactccgggaatgttgactgaccattataatccgacaaacaaaacagtcaacctgagtgagggagtttataatacatgtagtgtagcggcggctgccgttgcggctcacgaatgcggacacgccgtacagcatgcccgggcgtatgcacctttgcagatgcgttcggcattggtaccagtggtacagttctcttcttccatcgtacagtgggtcttgctggcaggtatgtttatgattcattcgttcccgcagctgttgcttatcggtatttgtctttttgccatgactaccttgttcagcttcattaccttgccggtagaaatcgatgcaagccgtcgggcactggtatggttgagcggggcaggggtgaccaatgcttccaaccaccgtcaggcacaagatgctctgaagtcggccgcctatacatatgtagtggcagctttaagctcgctggctacactggtttattacattacaatatttaccaaccgtcgcgagtaatctgtatcggaaaaagatagatgaagcgcaaaggcatgcagtgggtccgaaggacaggtatgatgcttttgcgcttttttatttggctgttgcaagaaatatcttcttctgtaccagcttccaaattcaaatatttcatgtatttttgcagcggaatttataaattttgattcattatggctacaaaacccagtatacccaaaggaacaagagatttttcgccggtagaaatggcgaaacgtaactatatattcgataccatccgcgaagtattttacctgtacggatttcagcagatagaaactccttcgatggagaacctgtctacgctgatgggaaaatacggcgaggaaggcgataagctgctgttcaagatacagaattcgggagattatttttcgggtctgaccgatgaagaactgctgagccgtaatgctgcgaagctggcaagcaagttctgcgaaaaaggcttgcgctacgacctgacagtgccttttgcccgttacgtggtgatgcaccgcgacgaaatcagcttcccgttcaagcgtttccagatacagccggtatggcgtgccgaccgtccgcagaaaggacgttaccgtgagttttatcagtgcgatgccgatgtggtaggaagcaactcgttgctgaacgaagtggaactggtacagatgattgatgcggtattcaataagttcggcatccgtgtatctatcaagatcaataaccgtaagattctgacaggtatcgccgagattatcggagaagcagataagattgtcgacattacggtagccatcgacaagctggacaagatcggtctggagaatgtcaatgccgaactggcatcgaaaggtattccgcaggaagccatcgacaaattgcagccgattatcttgctgagcggttcgaacgaagagaaactggaaacactgaagtcggttctggctgccagcgaaaccggactgaagggtgtggaagaaagcgaattcatcctgaagaccatcgctacgctgggtatcaagtcggaagtggagctggatctgacgctggcacgtggattgaactactataccggtgccattttcgaagttaaggcactcgatgttcagattggtagcatcagcggtggtggacgttatgacaacttgacaggtgtattcggtatggacggtatgtcgggagtgggtatttctttcggtgccgaccgtatctacgatgtgctgaaccagctggatttgtatccgaaggatgctgcactgggtactcagcttttgttcgtcaactttggtgaggctgaggctgcttacgtactcccgatattggcaaaggttcgtgcggcaggtatccgtgccgagatttatccggacagtacgaagatgaagaaacagatgagctatgccaatgccaaggctattccttttgttgctatcgtaggcgaaaacgaaatgaacgagggaaaagtaaccttgaagaacatggcaacgggcgaacaaagcctgctggctcctgaagaattgattgcagccgtacgctgataacgaaattttttattctctttttatattcaccctctttgcatccagccgatgtgaagggggtgaactgtttattggaagttctatctttcaatggctagaacgtatctatccaatcgtattataggttgggctgtttataagaagttccacccgtcaattgcccgaacagatcgtatccgatcgtgtacggctgggctgtttatagggagttctgcccgtgtctgtcggaatttatcgggacgttttttagaatttgtacaaaagaaaaaattttttgtacaaatatttcgggctttctactgaggttactgcatagatttcctgctcttttacgataacttcccgttcatggcttttcgttccgctgtatcctgatattgagtaacacaaacgtaaccggctcgtaagtgaatcatcaaccggatgcaatgtgtgcgaaatacggtcatcctatttttgcatcagaaaaaaatgagaagataggatgattgatacgaataagattatgctgacagcttcggcgatggtcttaagcatcagtgctcaagcttttacggtaaagggagtcgtgatagaccattcgacgaaagaaccgctcatcggggcaactgttcaagtggaagggacaactacgggagtgattaccgacatcgacgggcgtttcgaaatcagagatataaaaggtaaatcgtgtacgcttgtcgtgcagtatgtttcgtacaagacgcagaaactgattgtacagaaaggacaaaaggaagaactggtcatcgctttgtcgcccgacaaccagcagcttgatgaggttacagtggtagccagaaagaatctggaaaacgagcgtgcgctgatgatggaacggcagaaatcgagtgtggccatcgagaatatcggtgcccgggaaatgagtgccaagggtatctccaacgtggaagagggagtcaagaagataagcggtgtgtcggtagcttcggcgggacagattatcgtgcgcggactgggcgatcgttatagtacgactaccctgaacggactgccgattgcttcacccaatcccgaccataagctgataccactcgatttgtttccggcttctacggtgaagaatattacggtgagcaaggtgtacgaggcaaatacgtttgccgactattcgggagcacacatcgacatcggtaccaaggaacagaccggtgaggatttttttagtctgtcgttcaataccggaggaaaattcaataccttaggaaaagatacgtaccgcatggatcacgacggtactttgttcaagactccttcgctggacagcaagttgcgcgatatggagctgatcgattttgaagagtatgccgtaaacaataaactgtttaatacgaacttcgatgtttccaagagcaaggcgttgccggagtttggagggaacatcggggtaggcagaacattcgatatacagggcaatcgcctcagtgtactggcttcggctggtatcagcaacgaacagcagaccatgctggatgctagtgtacgtaccttggaggcgaccggcagtaccctgaacgactttcaatacgatagttattccaatgaactgaaaatagccggactgggtagcttaggttacagcttccgtcagcaggatcaggtgaactataccttcttttatgcccgtaatgcggtagacgactatatgtaccgtcagggttacgactacgaagaccataacctgataggcagtaataatgtgacacatatctatacgcttcagaatcatcagttgaacggcaagcatttcttcggtgagcgctggagcctgaactggggtggctcgtatagcaagacttcgagcgacgaacccgaccggcggcagattatgtttgtgcgtgaaggcagcaaaatcaatcttttcaagctgaaccgtcaggaaacgatgcgttactttggtacgctggacgagaaggagtgggtcggcagcctgtcgggtgaatataagttcggaacacagaataagttgcaggcaggttttacgtacaaggataagacccgcgactatgcttctactcgtttctactataacttgaacaagctgaatcccgtgatcgggagcgaagaggcggtgtatacgccttccgacttcctgaatcaggaagccatcgccagcggacaggtatccattacgcgttcgcaacagcccaaagacagctataccgccggaaacaagatttatgccggctatattctggccgatgtctatccggtagatgccttgctggtgaacgtgggtatccgttacgagaacagtcgtcagtgggtgaattatgccgacgacggcggtaggatgcagcgtcgcgagctgaactgcaacgacttgttcccggccatgaatttccgttaccagttcgaccggaagaacagccttcgtctttcgttctcccgtacggtaacccgtccttcgtttatcgagatggctcctttcctctatcaggaatcttacgggtcggctcagattcgaggtaatgccgatttgcagaacggctacaattataatctggacttgcgctacgagttctttggtgagggtggcgatatgttctcggctacggcttattacaagcatctggaagaccctattgaacagatacagcagttgtcgggaggagctacgatccattcgttccagaatgccagcaacggtatggctgcgggggtggaagtggaatttcgcaaagagctggtacgcgacctgcgcttgggtgccaatgcttcgttcatgtataccgacgtaaaacttcctgaaggaggtgcgtataccaatacacagcgtgcgctgcaaggagcctctccttacttggtgaatgcagacttgacgtacagcccgacattcggcgaaaccaaacagttgagtacggcactggtgtacaaccttcagggaccgcgtattcagtcagtcggtatctccggactgggcgacgtgaagcagcagcctgtacataccctgaactttgtaggcagctttaagttcagcgaaaaggtagctgtcaagttgcaggtgaacgacttgctgaatcagccggtggtcttcaagcaggaggttccctctaccggagaaaaagtggaggtagaacgcttcaagcgcggaagcaacttcgagataggcattacatataccttataaaaaagaaacagaacaacataaatttaaaccattaacttaaaacattttgagtatgagaaaaaattggaaatttgcggcaatgacattggttgcaggtatggctctttttacaacagcttgcagtagtgataacgatcctgccgctaatacaggtaacggtaatacagaaggaaacggtaacggtacggaagaatcttatgtgctcgataaagatattacggaaaacgtgacactggagaccggcaagaactatacgctcaacggaggtattcatgtaaaggccggagctacgcttaccattcagccgggggtgaccattactgccaagcatgacggaacggtagactatatcttggtggaacagggtgccaagatcgacgctcagggtactgcttcacagcctatcgttatgacttccgaaaagaaagaagcgggtgcatggggtggcttgcatatctgcggatacgctcatacgaacaacggttcgggtagctccgaaatcggtaacgctccttacggtggcaataatgatgctgataactcgggaacgttgaaatatatccgtctggaatatacgggatatgccttcgacgaagaacatgaggccaacggtgtttctttctacggcgtgggtaatggaacaactgtggagcacttgcaggcatacaaaggttccgacgacggattcgaatttttcggcggttctgtcaatgtgaaatacctggttgctaccagctgtagcgacgactctttcgactggacggaaggctggaacggtaaggcacaattcctggttgcttatcaggaaggagaaacgtcactgggctatgcctgcgactgtctgatggaatgtgacaacaacggtactaactttgcggctactccggtggctcatccggtcattgccaatgcaaccttgatcggtaacgggggagaggctcagggcgtacgcttgcgtgctggaacagaagtggaactttataacacgattataaccggtaagggtaaggccctgactgtagaaacagacgaaacagaaaatgccttgaagaacggtacttcgaaactggaatatgtagcgattgccggagaactttcttctaaacagggcatttatacaaatgctgattttgttcaggctacaggcaacttggataatcagacctttacatggaacaataagtatgtaggtacactcgacggtggtaaggatttgtcggccgacagcttcttcacttcgactgattacaagggtgccgtaaagagcggtgaagactggactgagggctggacattgtaagagggtgtcgaacctgaaatggctgtcttgaaatctcaacagtcacgctgacaggtgaaaatactaactggtaaatagaatcatgagctgtatcatgacttgcacaaagtttgatgcagctcatttttttgtatttcttgtattttttcttgcatctcttgcattgatcctgccgtgaacattcttgtttttgtacagggaactattctacttcttccgtattttcctcctgactcgacagccgtgaagagatttttcttttgggagtaatacccagttggcgaagcatctctgcctgacggatcacatttccttttcccgcagagagctgattcaatgccgtatcgtaggcattggaagtcgttcgtaaggtttcgcctatccgttcgaacgtttcggtaaagctgactagcttttcgtagagagccgttcctcgcttgacgatttcacgcgtgttcttctcctgatactcccgtttccacaagtcgagagccagacgcagggcagctatcaggttggtagggctcatgagaaccacctttttcttataggcataattccagaggttcggatcggtctggagggcaagcacataagccggttcgttgggaatgaacatcatgacaaaatccagcgacgacaagtcgtatttggaatagtccttctgactaagctcatcgatatgcgctctgaccgacgaaaggtgagccttcaggtattgttcctgctcgttccggtcggtactgccgatgtagttggcataagccgtgagcgacaccttcgagtcgataatcacctgccggttgtcgggatacttgaccagcacgtcgggttgcaggcgttgtccgttctcgttgcgcagcggttctccatgttcgtctttcaggaactcctgacggaaatattcttctccctcccgcagaccggagttttcaagaatcgattccagaatcatttctccccagttaccctgtgtcttggaatctcccttcagcgcacgtgtcaggttattggcttcgtcgctgatctgtttgttcagttgtaccagttcttttatcttgtcttccagcgagaaacgttgcttcgattccttgtcgtatacttctgccacctgatgcttgaactcgttcaggttttcgccgaacggcttcagcagactggaaaggctttcggcactcaacttgttgaaactttccgttttctgctggaatatcttgttggcgatgttttcaaattccaggttgaactgtttgtggagttctgccatttcctctttctgatgttcgagtttctcttcgagcgcccgcttttcggctcgtagcgaagccacctgacgacttgtctccacgtattgctgggttgtgctttccacctgacgctgtatacgctggttctcttccttgagctgttccagagctgttgccgcctgacgtttctctgcctgcagcagttcttcctgatgacttgcctgcaagtgtagttgtgctttcaacgcattcaactggcgggaagctgccagatatcccagcacccctccgactataaatgtaagaataaggtaaagtatttccatgttttttgttgtactatgataaattccgtgtaaagatacggcgaaacttttaacccgaagcagactcgtgttcatattttcactggcagacggggcttgcttttggcagaagtgtcagtcggagtaaaagtttttggcagagaaaaagtgacagaatgtcataaataagtcgtggcacgcttttcgtaagaggacaagtgtcccttaaaaggacaataaataacatgtataataacaaataaaaatataaagactatgaacattaaaccattagcagacagagttctgattcttccggctcctgcagaagaaaaaacaatcggcggtattattattcctgatacagcgaaagaaaaaccattgcagggtgagattgtggcagtaggaaatggcacaaaagacgaagaaatgatattgaaggtaggcgataccgtattgtatggaaaatattctggtacggaaatcgaacacgatggtgttaaatatctgatgatgcgtcagagtgacgttcttgcgattttgggataattcattagttggacttttaaacatttaagattattatggcaaaagatattctcttcaacattgacgctcgcgatcagttgaaaaaaggtgtagacgaactggctaacgccgtgaaagtgacactgggtccgaaaggacgtaacgttatcatcgaaaagaaattcggtgctcctcatattacaaaggatggtgtaacagtggctaaggaagtagaactgagcgatcctttccagaacacaggtgcgcagctggtgaagtcggtggcttcgaaaactggagacgatgcgggcgatggtacaacaactgctaccgtattggctcaggctatcgtaggcgtaggcttgaaaaacgttacagccggtgcaaacccgatggacttgaaacgtggtatcgacaaggcagttgctaaggttgtagaatcaatcaagtcacaggctgaaaccgtaggcgacaactatgataagattgaacaggttgccagcatttctgcaaacaacgatccggttatcggtaagctgattgctgatgctatgcgtaaggtttctaaggatggtgttatcactatcgaagaggctaagggtacagatactactatcggtgtagtagaaggtatgcagttcgaccgtggttatttgtcagcatacttcgtaactgatacagaaaagatggagtgtgtaatggaacatccttacatcttgatctacgataagaagatttctaacttgaaagatttcttgcctatcttggaaccggctgttcagagcggacgtccgttgctggttatcgcagaagatgtagatagcgaagcattgacaacattggttgtaaaccgtctgcgtagccagttgaagatctgtgctgtgaaggctccgggcttcggcgatcgtcgtaaagccatgctggaagatatcgccgtattgacaggtggtgtcgttatcagcgaagaaaagggcttgaaactggaacaggctactttggaaatgttgggtacttgcgataaagtaactatcacaaaagaaaatactactatcgtaaacggtggtggtcagaaggaattgattcaggaacgtatcaaccagattaaggctgaaatgaagaattctacttctgattacgataaagaaaaacttcaggaacgtctggctaagttgtcgggtggtgtagctgttctttacgtaggtgctgccagcgaagtagaaatgaaggaaaagaaagaccgtgtagacgatgcattgtgcgcaactcgtgcagctatcgaagaaggtatcgttccgggtggtggcgttgcttacatccgtgcaatcgatgctctggaaggcttgaagggtgacaatgcagatgaaactacaggtatcgaaatcatcaagcgtgctatcgaagaacctcttcgccagattgttgccaatgctggtaaggaaggtgcagtagttgttcagaaagttcgtgaaggtaaaggcgacttcggatacaatgcacgtaccgatgtttacgaacacttgcatgcagcaggtgttgtagatcctgccaaggttactcgtgtagctcttgaaaatgcagcttctatcgcaggtatgttcctgactacagaatgtgtcatcgttgaaaagaaagaagagaaagctgaaatgccgatgggcgctccgggaatgggcggcatgggcggtatgatgtaatcttcccctttctaataaataaggacctctcgtcttgggtttcactcagggcgggaggtttttttgtgtctgtactttagggtatttctgattttttttataactttccccgtgctgaaataacattacaacaagaataattatgacgaaagaagaactgatgcgtaaggcgatagaactttcggtgcagaatgttgccgaaggtggtggaccgtttggggctgtaattgccagaaacggggagataatagcaatgggtgtgaaccgggtaactcctgattgtgacccgactgcacatgccgaagtgagcgctattcgtacagcggctaagatattgggtactttcgatttgaacgggtgtgagatttatacttcctgcgagccatgtccgatgtgtttgggagccatttactgggcccatctggacaggatgtactatggcaatagtaaaaaggatgcagcaaagattggtttcgatgatgcgtttatctatgaagaactcgacttgaaaccggaagatcgccggttaaaatcggaagtgctgttgcccgaggaagccattaaggcttttcaggattgggagaacaaaacagataaggtagagtattaatgtgcttaaaaaatgaaagcaccaccgattacactgattgctgaatgattgctaagatgaacagtgtaatctgtggtgctttttcttgacacacagcttaattttgtatttgcttgtaaatttacattttcatttgcctttccggtgtgctgattgatcagtgctgttatcgtgtcatggtttcccacagtctcaaatggttttcttccattgtcaggaaactctttacgaatatttttttcagtttcttaatcatctctagttatcctgtttttatgttttgcaacacaaaattacaggttttagagatacgttgttatgttatatagtagaaaaattagctgttttatttaattcttgacgtaaatcaattcctaaaaagattgagtctgtttgaaccgcaggtaaaagtccctttgttaaaatttcagccggagaaattcactttcgaagttgggagtgaatatacctttgcctaaattatctctaatttcttccaaggtccagaaacgccctccgtccagttcttcactgggtgcaatctccccgtcgtacgtcgtacgatgactgaataccagttctttttctctatccgattcgaacacatagtgagtcagcagttccggggtaaagtcggttataccaagttcttcccgcacttcccgtttcaatgccatttccacactttctcccaagtcgacatgtcctcctaccgaggtatcccattttcccggttgaatatccttccatgccggtcgtttctgtaagtataattctccttttgaattgaaaacatgcaggtgtactaccggatgaagcagtttactgccgctatgacattcttttcgggtagcggctccggttatattgccttcttcgtctacgatgggaaacatttcttcattattgtcgagcatagccttttgaattaagttgtacgttgcaaagatacggaattttgtcgaaatacgtcgggaaaggaaaaagggtgaaggaaagaggctgaatcttattgtgtaagcacaatgcgtattcagcctctgatcagtgttatggataaaggaatttattttattcttctattgaaaactgtcttttattctgttagggaacagcgatagagggttgttctaatttcgatgggttaaaacaattctcttacttcaagttggtgtgcgatgaaggaatcaattcgaaaatagccttgattcgcttcatgtcaaatttaggtgtacggttgtagtaataaataccgtttttctcttgttctacatctgtgagctgcgtataacagaatcccattacatgtttggcatttttcaaggcttctacttgtccttgcaggcgcgtataaaactcttcttcggtttgtggcagattaccgtacccccatgaatttttgcgttcttcggcactcatccatcctatgcccccgaattcatcgaccatgtaaggctggccttcgtagacagccagatactttttgtcacggctattgcgataaggttcttgcccttccttgaacgtcaattgttcggctaagcgtttgccgtcttgctcataattgtgtacactccatatatcggtcaggatgtgatcgtccccactggcatcgttgatagggcgagtggaatccatagctttggtcatgtgatagatgtctcggattaagcgtggataagcaccgtcgcggcttccccatgtttcgttgaaaggagtccacgttaccagtgagggatgattgcggtcgcggaccacaatttcactccattcgctgataaagttgcgtgcggccacttcgtcgttgacatccattccccagcttgcactttcgccccaagtgatgtatcctaatttgtctgcccagtaataatagcgctcttcgaacaccttttggtgcaagcgtgcgccattgaatcctgcattcttgcctaaaatgatatcgttcttaagagcttcgtcagatggggctgtccatataccgtcagggtaatatccttggtctaataccagtctttggaaataaggttgattgttcagatagaatataccattggcaatatgtattttacgcatgccggcatacgattcaaccttatcgagtacttgccccgacttatcctttaccagataagtcagtccatacaagaaaggcgattctggtgaccataacttcatgtttttcacaggaagcactatacaggcattattggaacaggtagtctgttttctgctgataactttatcaccgtctttcagaatgacctccaagatattgtctgattctttgtagaaacttggagttgccaccaattgtttctggtcgatgtcggtgcgcagtaccatatcttttaaaccctcattggcaacagcttccatccagaccgtttgccagatacctgtgacgcgtgtatacgaacaaccaccagagaagaagttggtgcattgttttccgccggtctgtttgcctcctcgcaaatcatcctttacttgaatgaccagattgtgggtatttcctgcctttacaaagcgtgtgatatcgacagtaaacgacgagctgccaccccagtgttgctggactttctttccgtcgatgtacagttcgcaccagtaatctacagcaccgaaatgcaggaatatcttttttccctgccagtcggagggtatagagatttttctttgataccacatacaatttataaaatcggtatgtttgactcccgacaactcactttccggacagaaaggtactgtaatgttttgactgaatttctctgaactttgatattgtcggtcgactccagactgtccaaagtcaaagtcgaaagtccatgtaccatttagattgatccagctctctcgttcaaattgaggtctgggatattctttccgaggtaaatcgctggccttggcataaaaagccaatgacagaaagaatacgacagcagtaaagagttttttcattgtttattgagtttaagttttaatgatttgagttattcatatgcattgggaaaagcactgatgcgcaaacgtgcagctcccatgggaatcagtgtgatgctttctttttctcctttgggtgcattcgcttcgggcaattcatgacatagcccatattcatcgatcttccacgaaggaaccttgcgtcccgtagctttgatttcaatcggacagctttcttgcgtaaatgggaaattgttgtcgggccagttcttgcgaacgattttgaagtctttcaatgcatcttctttattcaagacaaaggcataattccatgcagatgccgggaatatctcgaatgaaggccagttgcctgcgtcggcaccttgttgccattgggagtctccgatagcagtctgacggctgtcgcgtttgacgtatctttcttttattttaagcgaaaaggtcagtggcccgtagtcaatacttacactgtttttgttgacttgccacgtacgcagactcaagtgcataggaaccgtcagttcaatggagtcatcatcattccatgttcgctggatacgggcatattgtccagccgtaagcggtgtttctgcactttttccgtttattttaagggaagcatgccgtgtccatgacggaatgcgcagatacagcggaaattcggttgctttctctgtttgaatggacagacgaatacattcttcgaaagggtaattggtgttttctatgattttgaccttctgatgattacctaccattatctcggcttggcacgatgcatataaggcaacagcagctccattatccggagtagccagtatcagatgttcggcatagtaaggccacccttgagcatggttgtgctggcagcaacggcaactgaacgggttcatcgccaaaaagggtcccgagttgtctatgcctggatgatgattcttggcatcgctggtaatctggttcggacaggttatataacgcaatgctttaaagtcgggcattgtagctgcgggataagtattaaatgccacatcttcacagttttctgcccaaaaaggatctcctgaaatttttagcataatttcgtcggatgccatttgttctaccatgccgcaggtctcaactccctgacgtggatcgatatatcccatgcgagcattttcatcggctccgaacattccacccggtacttgtccgaaagtccttcggatgaggtgatgtacattatagcttgccgcaagcatggcagaatctttgttcagcatgtaataagtagcaggttctctgaaacactgagctatattcacgttgtgccagttaggcaacgaagagggttgggtccagtcggctgtattgcgatgaattttttccgcgagttcaagaaggaaggattcgccagtatgattatataaccagtatacgctgagcagattatctccgccacgactgttttcccagtaatcctccagaaatttatcgtctgccagactcaactgccatttaaagtacttagtcattaagtcgagtacccgtgagtcatttgaatactcgtaatacgattgcaggcaccagagcatgatcatctgtgcccagagttcaggtttatctcctctcatattgataggaccgaatgagccgtcgggtctctggctctttaaggtagcctcgatccagattttagcttcatcaatcatttgttggtcttttaagatatatgccagatcgccatatcctttcagccagtaaggaacttcctcccatccgtgatcgccttgagtagtgagccacgcattattctttttttcgagccatgcactgatttcgttcagatgtccggttaagccgttcttttgtcgtatcagatattctttaagccaaccttcgggttgtatgcttcccacaggcagtttcatgaagtgttgtggcaataacggtaagcggttattactatagttggaagttgtatgggggaaagtcgttctttcaaccattgcaatatgttcatcttgctgagaattttttacttgtacacaggccgataatagtataatggctgtagcgtaaagacttgcttttttgatagggatgtttttcataggtgaatggattttctgtattgcaaaagttgtgtttttcgataagaatcaacaaaaaaaatgagtagataaatgaaaaaaactgaccattttggctgtgatggcaagaaattttaaatctttgaagtcgggataataaattttgtgtacttttgattaaaacaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgattaaaaaggaggcatttataggctaatgttccgattgtaacgttagatagttggataattgtatatttatgaaatcgaatatcattttctttttgggggcaatgttgttgagtttagtgtcgtgtaagcatacgggaacaagtcagtctaaagtagaaggaaattatttcgttaatcctattcttccttcgggaagtaattcgaatgcttttttctataaaggaaagtattattacacgcatgaaacgaacgacatgattctgctttgggaaacaagcgatatcacggatatggctcatgcgctctgcaaagaggtctggcgaccaaccgatccgaaaagcatgcataatttatgggcccccgaaatacatcggataaacgataaatggtatatttattatgcggctgatgacggaaatacagataaccatcagatttatgtgttagaaaatgatgcgcagaatcctatggaagggacatttaaacagaaaggtcctgttctgactaaccgcgaatggaactgggggatacatgcatctacttttgtgtataagggaatccaatatcttatttggtctgggtggcccaagcgacgtatcacggaggaaactcagtgtatttacattgccaagatgaaaaatccatggactttggatggagagcgtatcatgttgtcttctcctgaatacaattgggaacggcagtgggtgaatccggatggaagccgtacggcttatccgatttacgtaaacgaggcacctgcctttttccattccaaggacaataagaaattgattatttattattcggcaagcgggtgctggtctccttattattgtatcggcatgcttacttgtgatgctggtgccgatttactgaatccgaaatcctggacgaaggcaacagaacctgtgttttatcagtctcctcaggacagtgtatggggaccgggtagtccgtcattcatcccttctcccgatagtacagagtggtatatactttataccgcaagaaatatacctaatggcataacgggagagagtgaaagccgaagcccacgtctacagaaaatcacatgggataaaaataacatgccggtattgggaaaaccgttacccgtaagtacgttattgcccaaaccatccggcattaaataaatgatacggatcacaggactaagatcattcatccggactatctggtaaacggagatgggaggttttacaactttctggacagctgagtgtcctgctgttctggaagcttgtccacatcggtttctgtctaaaatgggcaaaggaattccttgcctaacactaaatttggcactacttggtagggtggaatatgcgctaatttaattctattaacgagtaatgtctatctattttttttgaccgaatagttgtcgaattaagccaaatagtgctttcagaagcttcgatagtgcaaaatggaaacttttcaagttccgttattttttgtttttggttacatttgacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgatttgaaacaaagaaacaaattccgtgtggttgggaatgactacatttagttgtctattattatagggacgacaaggaatttagaaggcttaaagccatggacacattgtctaatgtgaacaaaaaacgagaggatgaagtgatctctcaagacgttggatttacctccaaagttcccctcaaaaaacctgatatatcgggtgaggtgtcggtaaagtatgtcccggatgtgaataagagatggtttgtgttgagagtcacatacggtcgggaacgcaaagcatacgattttattatgaacgaccatacggaggcataccttccgatgtgttatgtacagaagatatacaatgggaagaagaaacgtattttaacgtctcttcttcccaattttctttttgtctatgcgactcctgaaaaagtggagaaatatgtgaagcagactcctgaactccattatctgacttattattacaatcatttcaaagtcggagaatttggtaaaaatcctcctttgactgtagggtataatgaaatgatgaattttatccgtgtaacaagtctgaataatgaacatgttcgtttggttgaatctcaacattgtcattataagagtggggataaggtccggattgttgatggtgattttgctggtgttgaagggagagttgcaagagtagctggtcagcagcgggtagtgatagaacttcctggtgtctgtctggtggccacggcgtatataccgacggctttcattaagcctattccgtcagtaagcgaaaaatagactcgtttagcaagtagaaatatacaagagtattatatggtaatccttaaaaatgttataatattatgagatgcaagaattgtggctggcctaataagccaaatgaaagagtttgtgtgaaatgtcatgctccattaagtgctgatgatgattctatagaaagagaagtgggtggtagtgaaggagatgcttctttaagcaagacggtatgtgaggaggatgttttcggtcaaagtatgaatgaaccatatccttctggcaataatcaggctgagacatccgaggaaaagactaaaccatgtccgaagtgtggctatcctgtacgtataggaacagagaaatgtccgaactgcaagttccctgtttcacaaggtggaggaaccagtcagcgacagcctactgtaacggtagacaacccgaaatcggaggaatctcattttcgtcctaccagaatgaatccagaagaaaacagaaccaccggattccgtggaaccatcaatccatatatgatgaatatggagatggaacctacatttgtattgaaacctatcagacggatgaatgagcgacacgagctggacgagcaggaatacgaagggaaggaaatctctttaaaccgtgcaaatacggaacccaataattcgtctattacgtcgcgtcagcaggctatcgtaactcgtatagacggacgttggtatatagaagacaagagtgaacagaaaaccacgttcgtacaggctgccaagcgtatcgagttacatgacggggatattattttgttgggaaaccggttgtttgaatttcatgaataaatctgtatagcgatgtctgttgttcagcgatgtgatttctttataggtgacaggatcgaccatcattttcaggtgcagaagatactgggagaaggttctttcggaaaggtatatgctgtgacagatcctaacggcgagctgcaggcactgaaactcctgaaattgtgggaagtcccttccgaaatccgagcttcattgatggcacgttttgacatggagttcgagacgggacgtatagacagcaaatacctggtccattctattgcgcatggtactgtaaacggaaatccatatattgtaatggagtattgtcctaatggtgacttgttgagtatcgtagcccagcaatatgtggatttgactaaagtagctacccatgtattgtatggtctgaaagccttgcatagttgtggaaaagtacatcgggatctgaagccggagaatgttctggtgaagaagaacggcgattatgcactgacggacttcggcatatccggcgatagaaacaagcgaatgaccgagcggaatattttggggaaacctaaacagatattcgggacatacgcttatatgccacccgaacagctgaatccgcgtaaagacgctacggtgcttcctactaccgatattttttcctttggagtaatgatgtatcagctcattaccaaccgccttccttttggtcaactggctttggaacgagacttggtaagttatctgcgccggggtaaaaatggtgactgggacaaggactatctgatgagccttccttctggtaaagactggtatcagttaattgacggatgtcttattccaaattttcaagatcgtcttcagacggtagagaaggtactggagcttgttccgcaagttcagcgtgtacagcaaacgattgtggaagaaggaaaagattttcagacgaggattgtcaatggagttttgctgcgtatcatgcagggagaggaattcggcagggtatataagctggatgacatgctccgcggagagtcttccatcttacgtatgggacgtatggatgaaggcgtatacaatgatatcgctatccgggaagagaacagcagttatatttcccggaaacattgtacactggaattggactacgatattggttcgtgggtcatcagggatggacaatgggacagatgtgagaccggtggatggaggaagtcgacgaacggtacttatgtgaattccagagaggtctcgatcaacggattgcctttcagcccgggtgatatcatatcaattggagataccaaactacgtgcagaagcatattaaaatgaagtataacgaataaaataatcagattatggttggtcataccactaaaccttataaaaatactttatccggttcggtaggagccggaatggggtcaatttttgctccgggtggaaagaaatattatatactggagcataaagtaagtagtaaatatcatcgggcaggagaatgtcaggaaattattgtagataacattacactgggacgtgattcacattgtcaggtacgtttcgatgaaagtttcaagactgtatcgcgccgtcatgcagccatcgtaaaagatggggacatgtggaaactggtacagatttcccagacgaattctactttcctgaacgggcgccccatcaagacggaatggtatctgcagaacggcgatgaaattcaactctccgtaaacgggcctaaactgggattcattatcccgaccgggaaaaaatcgacagtaggttccattggtctgacccgcagactcagtctgttcagacagcaggctttgagaccttacaaaacggcaatcactgtattgtcgtgcatacttgtgctggctgtaggtggattggctacatggggatttacactgaatgataggcttaaaatgcaaagtcagtctttagctgatcagataattcttgcaaaaggtaatcaggcactgattgattcactgaataaagaactcgtcgtagccaatcaaaaaataacagatagtgaaaagaaactgactgaaatcaagactaatttaggaaatatcaaagaggtagttgttcagcagcaaaaggtacaaacggagaataagatagatatcactccctattttaaggatatctttgttttaacttgtaagatgtattatgaagggaatcttgtaactggatggagtggaacaggtttcttgttgaataacggatatttggttacagcacaacatatgattcattatgacgctttcgctttaaagaaggtaaaagaccctcaagatccgacaaaagaaattgtgatttttgatccggatgatgagtcaaattacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgaaattatataaatgcatattattatgccggtcttataaaagtggtaatggaaggtatttctacagaaggtaagataaagatagaatattcatacaatgatatgccgtttaagttgggagaaacagaaatggcagaagagaaattcgtggatgaatccggacgtagctgggttgttagagcccataattacaggggaggtgattgggcatacatgaagattgacaaaacgggatctattgagtatgatgcagactactccatgaatctgcctgtccagactccgttgtcaattgtcggtttccctgccaatcagggtgaaacagtaaatggacagatttctcctatcgtatctcaggctattacttccagacaaggactggaagatgatggaaccattaaaacatcaaatgataattctgaccatggaaattcaggtggtcctgtctttgcagtcaaggatgggaaatatattgttgtaggtattttgtcaggagctgatccaggagctgactcaatgaaaggtagagtcgttccgataggtgctatatttaaatgattgtcatatgagaaagattatttttatcgttaattttttattgctctctgtctcaagttttgctcagttttcattagggcagagtatcgggcaacaatatgttgagaacgctgtacgaactggtctttttcttacaaagcatagttttagaatttgtgacgagaaatcgggtgatttgtttggtcttgatggaaaagatgaatttggatcacagtatgcttttggagtaaaagtaccgggtggaattttattgaccaataggagtgtctgtccgtggttatatgatgtcaattttgaaaaatataaagacgattatagtccggtgctttttcaggccttgtattcggggctggaggaaactccaaaatatgacttgcttgattatgaatatgacaaaaaagaagtagtggtagatacagccgtatatagattcatgtccagtacttttgacggtaaaggctttacgttagacaatacgactgggaaaaaagacggatggattatatgggttgttgctcatgaaaattctaattcagaaagtaatgtccagttggattttttggtttatcggaaagaaattacggttaacaaaaacggacagtggattgaagtggacaaaccggatggaaaacagaagatcttggggggaatctatgtagttcctacttttaaggaggttggcattattgaattccaattatgtggagtccttgctcaggcaaatacttcctggagaatatattgtccttttatcggaaaatcggaaagtaaaatagagcaaatagataaccaacagagctctgatgccgagttgactccaataggtaaaagtaagaaagacaaagcgaaaaacaagaaaagtcggaaatgaatacaatgaaaatcagactggcggcaaaaaccgatatggggattgtccgcacaaacaatgaagataatttccaggtagcagccgaccttacttcagataaaatgcagtggataaacaatgaggtctattcattaggagaaaagggaacgctgctggtcgtagccgatggaatgggaggtatgaatgccggtgaagtggcttctgagctggccattgaaacggtacgtgagtatttctcttcggatagattgacagacgaagtgctcaaaaaccgctattccatcgagaaatacatgaatgaagtgattgttgaggctgatgcgcggattaaacaggaagccaaacggcgtccggaaactcgtggcatggggacaacaatcgtgatcggatggatactggatggtaaactgtatgtttcctggtgtggagacagccgggcatatgtctataatccggtggccggactgcatcagatttcaaaagaccattcgtatgtgcaaggactggtagataagggggctatttctaaggaagatgctttcgactatcctgacagtaacatcataacccgttcgctgagtgacggaacagccaaagcgaaaccagaatcgctgctgaagccttatgaattgtgtgatggggatatcgtccttttatgtaccgacggattgaacggaatgcttagagagagtgagatagaggatgtcattcggaataatgaagcggacatggactgtctggctgacgaattgattaaggctgcctgtgaagcggccggttcggataatatcacaatctgtctctgtcagattctggaaggaggaggcgtctgtatgccggatactttcgagagtttcgataaccgtctggccgggaagcagcgactggatacgagagttccccagcatgatacagaagaaacggtcaaatggtatcgaaagaaaacctttataggcttgatgattgcatttgttttggtcctgattggtggaggatgctggttttggatgcaaaataagggcgagagtcaggtggaaatgaaggccgaaggagataagaaagatacagaaaaggatggaaaagctcagtccgcaacagatacaactgagatgagaacggaaactccttcacgtaccgaaaaaacaaatccaagtaagagcactaaggaacagaatgaaacgggtgcccctctgtctgtttctactgaaatagagaatagtctggaacaaattagcggtgtaagtaagccggagaaaactggagagaaaaaaaaggaggaacctaggctgacactgatacatgataatgaaccagaacatgctggagagaaaaaggaacagaatacgagaggtcaagaacctgaaaagcaaaagaagagtgatgaggatactcaaggggctgtccatccggattcaacccatacccaacagtatcaggtaaaagaaggagaaacttatttctctatagcaaaaaagttcagtatatcagctgaagaactgatgtcaatgaacaatacaaaaaacaccaggctgaatgcgggtgatataatattggtccccaaaaaatgaaggctatgaacaacaagagaattacaattggaagagctcctggtagtaatatccgtatcgaggaacggtgggatacagtgagcaatgaacatgcagagattgaagctataggcaatagtctgttattttatgaccatagttcaaacgggacaattatcaacgggcagaagattcataatacaaatgtaccaatttatccgggtgatgaaatcctgttggcaggtgtctatagattggattgggagatacttgagcgttttttccccatttcccgtagaccgactgtaaccaagaatatccacggagaggtaggcagaagtactgtacgtaaagatgtctatgcggagagggactatgataatcgccagagtggacgtaagacagagccctttaactataacaagataggtggtggaaacgattcaggctatcagattcatcaggaaagggaaaataactacggtcaggcaaatgcttattcgcaggcagagatagacaaggaacttgaaaaatggaactggggagcctttttctgtacctggttatggggtatattccatcggatgtattggcctttgctgattttggtagtggcggccattccttacctcggacaggtatgcagcataggtctctgcgtgtatatgggactgaagggttccagaattgcctgggacagcggtaaatacaaagattttgaaagctacaagaatgcccagcgtaattgggcgattgctggattgatctggtttatcatttctgtatctgcttcagcatttctggtttatactactttatctatgatatgatataaattcgggcattatggaactcagaaaaggatatttatttcatgatagatacttattggtagcatctcttggaagtggtgcttccgcagaagtatggaaagcaaaggatacgaaggcgaataatctgacggtcgctttgaagattttctctgaacattcagaattcgacacctatggcttacagaatttcaaacgtgagtttactacggtgtacaacatgaaacagtcgaatctgttaccgcctaccggatatgatgtctgcgcaggaaggccttacctgattatgcagtattgtgaaaacggatcatgcagtagtatggtcggaaggatggaagaggaggatatcatcaagtttctgcatgatgtggctgcaggactggaatacctgcatgaccataacatcattcatctggatatcaagccggacaatatcctgctggacgacaactgtaattttctggtgacagatttcggtatcagtgtcagtggaaatagtgacatcagtgattcgaacggaatgtcggggggaacccgtgcttacatggctcctgaacggtttgagggaaatacggcgaatgccagtgatatctggtcgctgggagcaacggctgtggaactgcttaccggtactcctccttatggagaacacggtggactacttcaagcggagggtgaaccacttcctgaacttcctaaattacagccggaagtgaaggggatgatcatgagatgtctggaacttgacccgagcaagcgaatccgggccaatgaaatccgacagaagatagaacttttttgggaaaccggatcgtgggttaaacattcacgtaagcagaccatcgccatattgcttaccgtggctgcgtctgtattgatgtgtgcaggtatcttcctgtgggattatacccgtacgaaagtctattattacaaggattattgtgaacattggggagtgcccgaaggtatcggcagattgagccgcaatgaggtacagcaccgtgagaggtcttatcggtttgagtaccagaagggtcaggtgagacgtttgacgttggtgaattctaaaggaaaggtagccaatcatacagatacagagttgatagccagtcgtttctcggatgtttgctactcctataccgaagatggaaatctggataacatgttcatttacgactcgaatggaaagatgctgtttaaactggattttgatgaaaacttacaaaccgctactttccggcagaatgacaaaaacggtacggagatgaacctgaatgccaacataaatgacctgtataagcagaattccggagtgtgggaggagaaaagccatatctcacgctatctgctgacgtatgataaggatggtctgttggtagaacgacgttatgctgctttccagaatgtaccggcctgtgaccgtgacagaatttatggacagaggtataagtatgatgagaaaggtagaaagatagaagaaacatttgtaggggcagacggcagtgtgacaagtaataagaatggactggctatcaaggtctatacctatgatgagaatgacgactggacctctgttacctatctggatgctgaaaggaacgcctcacacgatggcaataattgcccgttggtgaagttggaatatgacgagtatggaaaccgaatcaaagaatcttattatacactggatggtgttccttcgatacgtacggatgtaaatgtgtctggtttcatgtatgaatacgaccagcaaggctttcgtgttaaacaatcttgtttcggagtagacggcaagttggcttactgtacctttggatacgtaacggtagaaaattcctataatgagaatggatatctggtaaaggaaatgtatttggatgaagacggtaatccgaccttatacaatgatggaacagacagctactgttccgtttcgtcgaaacctaatgaaacggggctccctctggaaataagttatgcagatgagaacggaagcccgacagaactttcaatgggagctgcccgaattacttgtacgtacgatgaggctggaaatatgacatcccaatgtttttataataagggaaatcaaccagcagctgtagacggtttctatttcgagaaacgaatggaatacgatgagtttaaccggcaaaccagagaatattacctgaatgcggaaggtaagctgactacttcggatggagtggtagcagattatcgtatggaatataacctgcagggggctttgacaaaaatgtctttcctggatgaatatgggcatctggtgaatggaaatgacttctttgcaggatatgttattgaatatgatgaacgtggaaaccagaaaaaaatgagctacttcaatagcgacgggaaagcttgtatgacccgtagcggctattccagcatagtgtaccgttatgatgacaagactaacttcctgataggatccgaatactgcgatttgaatggaaatgttttgaacagttatcactatgcgtacgatgtaaaaggaaatatcgtaaaggagtatggagtagaagatggaaggcttcaatctggaatgactgtaatcaaccgttcatttgattcaaacaatcggattgtttctgaatggagtaccaatctggaggggaaaagaaccaactttgtaaaacagacgtattcgcagattaagtatgcatacgatgaacggggaaatacgaaagaaacgagctattggggaatagatggcagccctgctgtagatgaaatgaaaacacacagaagagaccgtgagttcgacgcattgaaccgtgtcatagttgaaaagaattatggagcagacggtaaacctatttcaggtgctaatgtgtatccggaaggacgagtgaaatatgaccaatggggaaatatggtagaaatttcctgttacgacggatatgggaatcctcaggtgggtgcagatggatttttcatcatgaaatctgaatacaataaaagaagaaatctgctgcatcaggagtatcttgatgtagacggcaagctggtcatgcataaaagtaatggttttgctaaagtggattttgcatacgacaatcacgggaataaactggaagagaagtattacgatacttccaaatgtatccggatagaatcttggaagtataacgaaaagaataagtttactgaacggctgatatgcgatggtaatggtaaactttcggacgcattttatggagtatctaaggtaactgtcaaatacgatgattcgggtattaaccctatcacgatgaattactataaccagaacggaaaactgattgctaccaagaaatgggatgtaaaaaacggtcagtggggggatatgaattttacggaaaattcatcagtttcctattctgactggcagcagagtgtacagcaggcggcgagagaatgtccttacaaactggccgacggagtgtatgctcagtctgttacttataccgcttctgctataacactgacaatgaaactgaccgaggtgtcgaaatataatatggcggaactcagtgaagataaggtgaaagaggtaggaaaatccatgaagatggaattgcggaagaatctaagtctgcccgatggtgtggctgtgaagattattgtcatcgataaggctgatagaacaattcttgtactttaaaaacagaccgatatgaagcaaatgatttataagctgtggctgtttgtaggtttctgtctatggggcctgcaaggaatatgggcagatggactgacaccggaacagaagaaattccagtcaaatctgtatcagtttctgaaggaagaaggtttttctcctgaaattgatccggaggataatagcgtaaccttcagggaagatgatgaacttttttggcttttggtgagtgattcgaatccctattatatagaatttcataaatctgggttcaaatgtactgatgctgatttgaatgttgtcaggagggctgtgaatgaaggtaacctgaaggtacgttgtgccaaagcgatgttttctggtgaaaccgtttcattggctgtagagatgtattgtcattcaccggaggagttccgttatgttttctacaagagcaaggaagaattgttgaaactggaaaagacagtcctgaattattataatgaaaatgaaggatcaaatcatctgacacatgtatcaagcggaacggcaataaacaaattctttccggtttatggctttactgtgggccaatcgacggtaaaacaaatgaaagcacaggactatattgtcaaggaaacggattccggtgcaaaacattgtgatgtcaaaggactgactttctgggattttgataaagataaagtttttgagtcgatttatatgaccgactcttcttatatgcccgacaaatgggtgagcttgggattgacttgggagtcaagttataaccagatattgaaactttttaagggaatgggattctcgatcaatatcgaggagaagccggaaacgaagaaattcagtggacgtaaaacgctttcggcaaaggttatagctgtatcggccgacggtgccctgcaattcaagtttgagtttgattatggaaatgaaaatggagaaggctattcgttgaattctccaggttccttatatagtatagatattgaagctttgaagtaaaaacaatggaacagaacaatttatttcatgataggtatttcctggaacgcttgttaggccggggaaatttctcagaagtgtggcttgccaaagatactaagaccggcataaaggtagcgttgaaggtgtatgcaccagctaccggacttgatgatgcaggtctgaatgtctttgcacgagaattttcattggttgtgaatgctaaccacaagaatctgttgaaacccttatattatgattcctgcgaccgaaaaccttatctggtacttccgtactgtgaaaaaggaagtatcatgaaactggtaggaaaattttcggaacaggatgcctggaggcttttgcgggatgtagccagcggattggcatggctccatgctatgaatccgcctgtcattcatcaggacatcaagccagacaacatcatggttgcagataatggtgattttatgattacggattttggcgtcagtacacacttgaggtcaacactacgtaaaagtcttagttccgcattcagttcggcgggaacagtagcttatatggcaccggaacgtttcggaaaggataatacgcccattatggcaaatgatatctattcgcttggagctaccgtattcgaaatgttgagcggggatactcctttcggagatgatggaggactggtgcagaaaaagggtgctgagattcctgagttgaaaggagattattctcctcagctaaaaaaattgatttataaatgcttgtcgacagatccgtggaaacgtccgactgcggaacagctggagcagtatgccataacgggtttgtctggtaataccataaagtatgtagacgaaaagaccgcatggcagaagcataagttacttttctcggtagtgggaggtgtacttgttgttgccattattggtggaggaatgctgataaagcatcaagtcaatgtaaagagggagactcgtgaaaagatggcaatcatggctcataatgattcggtacaagccgaagtttctcaattggttttctcggctgatagtctggtacaggtaggcgatttgcatgatgaaggttatgaaagagcttacttgaaggcctatgacaattatgaatctgctgaggaactggcccaaacgttgcaggatagcgcgaatgttgacagacataaaaatctggacgacaagaaaagtcagttggaacgcaagctgtatgatgcttatgtctctttccaggaaaagtcacaactatttaaagatgatgtggaaatttccactgaattcaaggaacgtgccggtaatatcagttctgttataaatgttgcagaatttgagaataaacaggaaaaggctgttccagaagagtaactgtatatgattttatcaacgaatattattgttatatttaaatgcgtatgaaatattttattggatgctttctgtggagtatgatgtgcatgtctgcgcttgttgctaatgcacagagtgcttgtgataaactttttgcaaatggagtaaaatgtcagcagacgatgactatctcttcccaaagaaatgcaatcggttattttgagaaggctaaaatctgttatgattctcaggctaagaaagatttgtgtgaccagcagatcaagtcatgtaggaacattattacccaattgacacgtacggaagaagctaagaaaaaggaatcacagactagggaacctgaagaaaatgatcgaaataaggcaaaaaatgacttgaaaccggtcaggaaaaatggcgaaataaagctgagtctggatcgtacctatataaagttcaagggaaaaggtaatgagtttcagaaggtgaaagtaacttgcaattatccggattgggagataacgaagatgccggaatgggtaaattgttctaaaaatgaaaataatgaaatagttattgaggtagagaagaatcctaatgatgtggaacgatctgctcaacttgaagtaacttgtggtgatgaggtcactaccttaaccatcatacaggaaaagttcaagaaatttatcttgttctgatagctcttgttcgtgtcgatttcagacatattgtctgaatatgtttgtaatgttcatactgggtgtactgaattacggactgtaaatcgactatattactgattgtgaaacaatacgtcgcgaaagtctctgcaggttggacaaccctaagggtacctgtgtggatgtgctcttcatgtaaatattgatttatcgattatttctttgtcgataaaatcgtcggagtacggaaaatgattaaactaaaaatataagatgatgaaaaaaatcaggttattttttatcttacttgtacttgtattgttaggtacggtacatgtaaaggctcagcatactggtagttatcagtgcaccaaaattgttgaagcgaacgggattatgaaaaagggagatgctccgcatatttggtactttacgtttaatcaaaaggtggtgtatgaatcagatcagtatgggaacgctactcaaggaggacaaatgtacgcctattttttcgtaggcagacagggagatatgatgatattcgagcagcggtcattactagatcatagtaatccttttatcgttaatatggaaaatgtgctaagtaattatacaggtataaagagtactagaatgttagtttccaacgattacaagaccttgaatatttgtcattatgatgccaacaacaagctggtccgaacgagggtctataactatgtggatcctcaaaaacctggagcagtagaaattcctgatttaatcagatgaaaaagctattcacattcggtatatggattgttttgttgtttgttgtggtatcctcaacagcacaacgtcgttatttttacagtctgaaatatgttaaggtagggcagaacaatgtaaaacctccctactcggcaggcatgtatgtaacctttcctgccagtaaggatggtaagtatatatgttatgactctgatcgtaacggttatgccgtaaatgcttctttcaagttggattatataggaaataatcaaaaagcttattcatattatggatggacttattggggacaggcgtactacaatttctcgagggattattcacttttgaatgttgtcgacgagattggaaatacttatgtcttttatcgtacgaacggaacgcagccgaactctacttactatagtgtaacagattctcataccgataatagtgggggtacaggaagtacagtgattgtttctggtagccctaattcgtcgggaacatcttcccctggaggaaaaacaaaaagaacggtacgggtaaaatgccaattctgtaatggaacgggtatttcttggtcggagaaagtatatttacccaattatacaggttcggacgaaagacagtggtgtagccggtgtaatgcctgggggattccccacaagcatatagatcatcgttgtacagtttgtcgtaatggctacatagaaaaagaagaataaatgcggatatgcctcttctgacattcatctaaaaaactggatgatgcttccagtctgtaaagtacaaaaaaccgcctgtcattgtgcgcatgtgccaatgacgggcggctttcttttattggatacgatcttagggtatacagtttttagagatatttactgaataccctaatttgatacgggtaacaaaacgtgtatgcaagtgtatatgctatctgtatgtcagttaagcgatttggtataatctttcggaagtacgccgaatttcgctttaaaacatttggcaaaataggatgacgaaccgaatcctgtacgttcaaaaacctccgttactcgatatccttcttttagtaactgggccgctttattgagtcggcagttcttcagatagtcgttaggcgacattcctgagagtgctttcagtttccggtagaaattcgatcggctcatgtgcatctctgtagcaagcacatcgatagagaagttttcatcattcagctgtagctctatgatttcttgtatcttttttatgaattcctgatcttgtgcagtaaatggaatgtaatcttctttatccttttcttcaggagttgcttgagggaagaacgacgccatacgtttctgaaatgctgtgcgtaagttcaacaaatttcgtatttgcatatgtaattgctgaattgtgaatggtttttctatataagaatccgctccataagaaaaaccttcctctttcgattctggcaaggtcttggctgtgagtaaaataaccggtatatgcgaatattctatgttacttttaatcttatggcacagttcaaatccattcatcagcggcatcatgacatccgtaaccacaatatcaacatcttcgtctttcattatttgtaaggcttctattccattttgagccttcaatatgtgataatactctttcagtccgttacattccagttccaacaaatctcggttgtcttctacgagtaatattttagccttggagctgctggctggcttgtcattgctaccttccaaatccatatgagaccggctgtcggggagtatgatacccttattctcctctttctgaaggtcttcattgtaaatgggaagtgttaagatgaaggcagatccacctaaagagctgttttcaacatgcagtgtaccatggtgactttctgccagagcccgtgaataagccagtccgatgccagtgccttgaatcgattgtccgtcggccacttgataaaagttctgaaatatcttttccttttcagcatctgcaatacccggcccgtcgtcttctacgatgattgaaaactcctttgcatcgttttttactgtaatcgaaatgacattattggcatatttcatcgcattactcagtagattaaccaaaatcctgttgagtttgtctccatcgaccaaggcctcaagattgaagtcctcgggctgatggatagagaggctgatgtttcttaaatcggcagatccggcaaattgttggtagatactattgatctgttgagatatgtcacagagtttaagatgtaattttatctcacctgattccatcttttgaaaatccagcaattcgtttgtcactcccagtaaataatccacgtttttattgatcacctgtagataatgctcttcggtttgcttatctatagccgcatgcatgatactttccaatggcagttttataagcgtcagtggagtcctgatttcgtgtattaagttgataaagaaattgactttgtttttatagagttctttgtcttttttaatttgatactcttcgattcttttctggtactttgcctttagatagaaatctcttttatatagtacataaataatgaggcaaatggcacatgcgatataagcaagatacgcccacacggagcgataccatggaggagtaatgatgatccataattttgctatttgctcattccatttttgatcgttgttcgacccttttacggagaagcaatattttcccggcggcaagttgtgataggtcgcaaaattttctcttatgttgctgttccattccgtatcaataccttctaatttgtatgagaaatgatttttttgaggattctggtaacttaacgaagcaaaatagatggaaaagctgttattgttataaggcagttttatctgtttggtcaagaaaatcggttcttccagattcagtaattcctgtgtatcttgagaggaatccgaatgggtcaaaataaaatccgtaatatagactggaggtataaacgtgtttttttgaacaaatgaaggttggaaagaattaaatccattggtacctccgaacaataaagtgccatccgatatcttgtgagatgcacgttcacaaaacaggttttcctgtagtccgtctgagtttgtaaaatattgatagtcgtcgaaatttttcggatttacccgaataagtccgatgttacttgtaagccacagataaccgtagaaatcttcttcaatggaatataccacaagcgttgagagctgcttgtttgtaaaggtggtaaaagtctccgcctcagcattgaataagcataatccatttccattagttcctaaccatatttttttattggaatcttcaaataaggtaatgatagagttattgatcagcgaagattctactccttgtttatgttcatagtgtttccagtaattagcatttttattattgaaaaatataccattattggcagttgtaatccagaggttgttgtgggaatcttcgtatatgtcagtaatggaaatcatggccccgacagatgtttcggttctgaaattatcttcttcgggattataataacataatccccagttggtaccaatgtagatggttccatcgtggcatttatatattttttgaatattgttgctgcaaatggtattaggtatattataagaatgctggtaagtccttattttaccattggtcagattgaggacttttaagccgttcgagaatgtaccaatccacagttcgtcttcttttaggcaaagacaacgtatatcataaagttgtttttctttttctactaatggatattcttgtatgtcgttgctggtcgtattataggtaaataaacctttttgagttccgacccagacgatgtggcgtttgtggtcttcatagaaggcattgaccgtggggttgcccggtattttgtgaagattgaaggtcttgttctttgggatgatgtgaatagctcccgtctggttggttaaggcccagatgcccccttctttatcttttatgaaagcattgatatttgggtccgttatattggttccgtcgttgttatgaatctctgttaagttagataaagtctggtccttataattatatagatagattccattgtctgtcccaatcaggaaggtatctttggtaaaaggaattaggcattgtacaatctggaactgatcagattgcagtttacggcaatcaacctttcccgtcagagtgtttatttcgaataagaatttgctgtcagttccaatccacagacttttcccgataggtaatatgcagttggtctttaggtaattttttgtttgttcctttgtttgcaatggaaatgattgaataaacttctgtttcttgtcgaggcaaataattcccttttgcagtgatgcgatatagagtttatggtcgctgtctacatatatatcccacacaaaagataaatactggttattttgtgtcagtgtatcgttttttaaattataaataaagattccctgccctaaggtggctattgctatttcttcatcggaaagctgaatgatttttctgacctcactgctgatggatactccgaatttagtcatttgggtgaacgggatgaatgtgttttttctatcgtatatatatataccccggtcggtacctacccatattctccgttgcttgtcttcgaataaggaataaatgaaattgctgcctaatgattgtttcttgttttgggaagaagttctgaatatcgtgttgcgttgtccgtcaaaacagttaagtccattgtctgttccaaaccagatgaatccgtagctgtcttgtaaggcacaccatatcgtattgtgtgataatccgttttttaccgtgtaagaatttatgacaaatgatgggaaaagttcggctggagctactctggtacatagaaagaataagaacaataaaatgcaagttttttttaaacgaaacaaagtgtagatttttgataacataatatcccgtagctaacaatttctcataatggtggtaaagttataatatatttgataaaaactaataatattttctattcttttcatttcgtttgtgacacagtattgatagtcgtgatttatgattgctttttgattagatattactattcattgactaagaatttttgtaaaaaatgccatataaagcttttctttgccacaaaaatattagagtcctttgtgtaaagtaaataaatgtacttatgaaaaaaacattgattttatctatgctatctgtctttcttctggtagcatgtatggggggaaaacaagaaaattcagtcgagcttactgaatcaggcttaaatccacagaaatttgtaactgatgtagatggaaagaaaactggcttgtatatattaaggaacaagaacaatatggaagtttgtgttacaaactttggaggaagaattgtgtcaattatggctcccgaccgcaatggtaccatgcgtgatgtggtattgggtttcgactctattcaggattatataaagtacccttcagattatggagccagcatcggccgatatgccaatcgtattgctcatggtcgtttctccttggacggagtaacctatcagttgcctcaaaacaattatggacattgtttgcatggtggtccgaaaggttttcagtatgtagtatacgatgttgctcatgttgacagtagtgaaatcaagttatgttatcacgccaaggatatggaacaaggctttccgggaaacctggactgctctgttaccatgaagcttaccgatgacaactctattgatattcgatatgaggcacagactgataagcctactatcgtaaatatgactaaccattcttattttaacttggatggagatccgaatagaaataattcagagtatttgttgatggttaatgccagcaactatacacctattgatagtactttcatgacgacaggggaaattcttccggtagaaggtactcctatggattttcgccagccaaccgtattgggagaacaattgagtaaagattccgaacagctgaaaaatggtcatggaattgatcacaactgggtacttgatacaaaaggtgatatcaatcaggtatgtgcgtcactggaatcgttgtatagtggcatcaaactggaagtttatactgatgagccgggtattcaggtatataccggcaacattctggatggaactcaaacaggtaaaaaacatataacatataatttccgtgcatctgtatgcttggaaacccaaaaatatccggatactccgaataaaccccaatggccttcgtgcgtattacgtccgggtgaaaaatatatgagtcatacaatctttaagtttacagtagataaatagtttatactatgtggttgtacattttttgttctaatgattgttgtattatctagttgtagaaaagccagatatgatgaaacagataatatgtctgattatgcagatggaggcaaaacctgtacatcccaaactcgagattattctgaacatcaaatgtttcaaaacagctctgaagcgtggtacattgtttggtcgtattgcatggtgtccttctggttccgatcaggctatttattcggagtaatttctttgtaaggtgagaagattgtaaaaaatctataagtttatgatgagttatggggaagttaaacaaaagatagtatgtaacaatttataaaatcagatatgaagttaaagtttttattttgcataggtatttcagttatatctatgtgtggttgtagtaatggagacggtaggaaaatgactcacgagcctaatcggcttcgggctccgatgtatccattggtgacaatcgatccctatacaagtgcatggtctgcttctgataatttatttgatagtcctgtaaaacattggaccggaaaagattttcctttattgggggttgctaaggtcgatggagtttcttatcgttttatgggagatgaagagttatcgctttatcccatttgtggtacttcggagcaagtcgactggaagggtagatatacggtaaaacaaccagccgatggttgggagaaggccgatttcaacgatggatcttggaaggaaggtgcaggagctttcggtacgaaagaaaatgaggcgatggcaaaaactcaatggggagatgagtttatctgggtacgacgctggattgatataaaggatgatttggcagggaaaaaattgtatttagagtactcccacgatgacgatgtcattatttatgtaaacggtataaaggttgttgaaacgggtaactctgccaagaagtatcaatatgctgaactgccggccgatgttgttgcttcattgaaacccggtaagaacctgatagctgcttattgtcataatagagtaggaaatggtttgttggattttgggttgatggccgaaagagataatacccgctgttttacccggacggcagaacaaactgctgttgatgtgcaggctactcaaacttattatagttttacatgtggaccagtcgacttgagtgttaagtttactgctcctttgttgataaataatttggatttgatgactcgtccagtcaattatctttcttatgaaactgcttccaatgacggacaagcacatgagataagtctttactttgaggctgctcctcaatgggctatcgaccagccataccagaagtctgtcagtaagaccggcaatacagagggtattacttatgtaagtactggtagtgtagaccagcagattttaggaaaacgtggagatgatttacgcattgactggggatatttttatatggctgctccgcaggcagaaaacattttgtcggctacaggtgatggcgtttcaatgcgaaaagcatttgtagcaggtaatgacttgaatagccaatcaaccaatggcttcgataaattagtgctatcttgtaatttgggcaaagaaaagaatgcttctggttatatcatgttggcatacgatgatatttattctattcagtattttggacagaatttgcgtccgtattggaatagaaacggaaaggagactattttctcacagatgaagaaaaccgttgttgaatatgacgaactgatgaagcaatgtacagagttcgatagcaagttgtttactgaggctgaaaatgctggaggacgtgagtatgccgaattgtgtgctttggcgtaccgtcaggtaatggctgctcataaactggtacaatctcccgaaggtgaattgttgtatttgtcaaaagaaaatttcagcaatggttgtatcaacactgtcgatttgacctatccgtcggctcctttattcttggtttacaaccctgagttagagaaaggcatgatgaacggtatcttttattatagtgagtctggcaagtggaagaaaccgtttgccgcacacgacttaggtacttatcctctcgccaacggtcaggtatatggaggagatatgcctgtcgaagaaagtggtaacatgctaattttatctgctgccattgctaaggtggagggaaatgcacagtatgcggaaaaacactggaaagttcttactacttgggccgattatttactggagaagggacttgatccggaaaaccagctttgtaccgatgactttgccggacattttgctcataatgccaatctttctataaaggctattttaggcgttgcttcgtatgggaaattggccggaatgcttggtaaacacgatgtggccgaaaagtatttgagtaaggcaaaagacatggctgctcaatggctcaagatggccgatgatggagatcactatcgccttacttttgataagcctggcacatggagtcagaagtataatctggtttgggataagttgttggggctgaatattttccctgaagaggttgctcaaaaggaaatcgcttactatctgaccaaacaaaatacttacgggttgcctcttgatagccgtgaaacttatacaaagaatgactggattatgtggacggctgctatgagtactgatacagctactttcaagaaatttatttctccggtgtataaatttatgaatgaaacgccggatagagtaccaatgagtgactggacatggacacttgaacctcatcaaaaaggttttcaggctcgctctgtaatcggcggatactggatgaaggtactgatggataaaatgttggtgaaataaccggcatgctcagttgagtctgtataaatgctgtggagatgacctccggagagtttatacagactgtttttatatggagcgcattttttgttatctttattactcatcttaaaatctggtaatgactataaaaaagaaatttccaatattgttgttgtttgtgtgttccggcttttctttaggtgttgcccagaaggtatcggttgtttctcctcgagttgaaatgcaggaaaatccgctgggaatagaccggaaagatcctcatttttcatggcagctgaagtcgggtatgaatgatgtgcagcaaactggatatgagattcagatgggaaccgatttgcagggactgaaacggggaaataatctgatgtggcagtctggactggtttcttcggatcacatgcaggtcggctatcagggctcacctctacagtcgggcaaggagtattactggagggtgcgtgtacataccaattgtggggagagtcattggagtgctgttcaacggtttaccacgggattgctgcatgacacagactgggtggctaaatggattggcgaagatgcgatgtcaaatccgggtgagtcgcagaccgaactgcatacccgtttggctgccaggtatttgcggaaagattttcaggcgtcctctcatgtcagtcgtgctacgctgtatatcagcggattgggatattatcaggctttcctgaacggaaaatgtgtgagcgaagatttgcttactccctctattacgttctattccgaaaccgtatattacaatacgtacgacgtgaccaggttggtacacggaggcgacaatgcgttgggggtgattcttggaaacggtcgttacttctgggtaagaggaagcggtatggaagggtttggcttgcctcgtttgctggcacagctggtgattgagtatgccgatggtaccaaaaaaatcatcgcttcggatgagacttggaaggttacatcgaagggaccaattgttgccaacaatgagttcgacggtgaagaatatgatatgcgaaaagaattgtccggatggaacgtgagcggatacaatgatgctgcttggaagaacgcagatatcatgtcggttccctgcaagcgattgcgtgctcagccgtgcccgtcggttgccgtcatggaacgtctgaggccgttatctgttacccgtctggcatcgggtaaggtcctgatcgatatgggacagaacatggtaggtcggctgaatgcttcttttcagggaaaggaaggacagaaagtgattatgcgttttgccgagcttataaatccggacagtaccttgtatgtagccaatttacgtacggctcaggctaccgatgtgtttactcctgctgccgatggacgcttttcgtgggctcctgtttttgtgtatcatggattccggtatgtggaaatagatggtatagagggacgtcccgatacggacgattttgtaggcgaggtgatgtacgacaagatgaaatgtaccggcgattttgagacgtccaatgctgtcgtcaaccagatttttaagaatgcttattggggtatccggggaaattatcataacatgcctaccgactgtccgcagcgggacgaacgtcacggatggctgggcgaccgtgctaccggatgctggggcgagagtttcatgttcgacaatgcgttgctgtatcgtaagtggttgcaggatattgaagagtcacagcgtgaagacggcgtcgtatcggctgtttcccctcgtttctggacgatttattctggcgatgtaacatggccttcggtgtatatattggctgccgaaatgctgtaccgtcattatggagatacgacagctatcgtcaggcactatgattccatgaaatgctgggtagagtatatctgtcaaaactccatgaaggacggactggtggtacgcgatgaatggggtgactggtgcatgcctcccgagtctcccgagctgattcattcgcaagatccgctgagaaagacggatggagctatattgggaagtactaccttttatggattgctgtataagatgatggagtttgctcgcctgacagggcatccggaggatgttgataattaccggacacatgccgaagtgttgaagaaggcgtacaacaaacgcttttttaactatgaaacggctcagtacggcaacaactccgttacgggaaacctgttgtcgcttcgttacggactcgtgccggagggatacgaacagcgtgtcttccagaatgtagtcgacaaaacggaaaaagactgcaaggggcatgtcagtgccggcgtggtaggcatacagcatttgatgaggggactgacggaatatggccggaaggacctggcgtataaaatcgtgaccaacacagattatcccagttggggatatatgattgaaaaaggagctactactatttgggagttgtggaatggagatacggccgcacccgatatgaactcagccaatcatgtgatgctattgggcgacttgttgatctggtattacgaaaatctggcaggcatcaagaatgccgaggagtctgtaggattccgtcacatcgagatgaagccctgtttccccgacggactgtcgtatgtcaaggcttcctaccagtcggtttccggcgagattgccagccattggagccggacaggaaaggagttttcatgggaagtgacgattcctgccaattgctcggctacggtataccttcctatagctttgcatcctgaaaagccggaagctgtcagggctcacagcatcaagcgtgcaggagagtattgggttgtggagttgggctccggagactatcgctttcaaagtaaaatctgagcatattttcctgaaaagttggtgagattttatctttttctgaatagatttttcgcataagattcgcttcttttcagcatctttgtaatagagttgttaacagtgacaatatagcagtgtaaaagagggagattctctcttttatgctgttgatttgtgtattataaatttatgatgatgaaaacaaaaatatgggcatctgtcgtcttatcttttatggcgtgcgggggaatagcgcaaggtcagtatcataacccggtcatcgacgagagtttgcccgatccgactgtgatccgtgctgacgacggatcgttctggctttatgctaccgagaatattcataatcttccgatttatcgttcgaccaatctggtagactggagctttcaggggactgcttttactgatagtacacgccctgatttcgtaccggatggaggcatctgggcacccgacatcaatcagatcaacgggaaatatgttttgtattattccatgtctacatggggtggggaatggacatgtggcatcggagttgctacagccgatgctcctcaggggcctttcaaggatcatggaatgcttttccggagcaacgaaattggggtaagaaattgtattgatcctttttacatcgaagacgggggaaagaaatacttgtttttcggaagctttcatggcatttatgccgtggaactttccgatgacggtctgatgctgaaagaaaatacccgtcccttgcgggtggcaggcgatgcctacgaaggtacttatatctgcaagaaagggaaatattattatttgtttgcttccatcggcagttgttgcgaggggttgaagagtacctataccacggtggtgggaaggtcggagtcgttgatgggaccttactggaataaggagggcaggtcgatgctcgacaaccaacatgaaatattgatcaaggcaagtaatcattttgtgggaacaggacacaattcggagattgtgactgataaaaagggacaggactggctgttttaccatgcagtgaaagtgtccgatccggaaggaagagtgttgatgctcgatcgggtacaatggaaggatggctggccggaagtagaaaatggcgttccttccgacagccacgataagcctgtcttttagtatgtataacttaaaaagagttgggtaatttatgattttgaaacgatttgtttttgctgctgcattggtgggatgcttgcccggaatcgctttttcccagagcaagggagataagacgaacggtaatccgatagttgccggctggtatgccgatccggaaggaattatctatggtgattcctgctgggtgtatcctacgctttcttttctgtatggtgaagatgtacaaaagtatgctcaggatttggaacggaaaaccgatgctatcaatcaggagtataatctccagacacatttcgacgctttctcctccagcgatttggtgcactgggtgaagcatccggaagtcttgtctatcaaagacgtaaaatgggccaagtatgcgctgtgggctccttcggtcattcatgccaatggaaaatattatctgttctttggggcaaatgatatacagaacgaacagcagaaaggaggtataggggttgccgtggccgattctcctgccggatcctataaggatgctttgggaaagccgctgattgataagatcgtgaacggggctcagccgattgaccagttcgtgtttcgcgacgacgatggtagcttttacatgtactatggaggatggaagcattgcaatgtcgtgaagctgcatcccgatttgttgggactggaacctttccccgacggaacggtgtaccgtgaagtgactcccgaccagtatgtggagggaccgtttatgctgaagagaaagggaaagtattattttatgtggtcggaaggcggatggggaggacctgattatagtgtggcttacgccattgccgactcgccgatggggccgtttaagcgaatcggaaaaatccttcagcaagatccgcaaatagcgactggggccggacatcattctgtcgtacagattccgggcaaggatgaatattatatcatctatcaccgtcgcccgttgggttgtacccgcattaatgaacggcaagtgtgtatcgataagctggagttcgatgagaatggatatatccgccctgtcaagatgacgttcgagggggtagctcctgtcgatttgcggcgataaatttctgaagtactcatgctgtcaagataaagacggggtgagtacttttttcgatgggtaatgattgatagtataattaactaaaaaaagtattgaaatgaaacgtattgttttcttggattatatacgcatcttcgcatgctttttggtcatgctcgtacatgcgagtgaaaattattacggtgcagccgggtcgacagacatggcaggcccgcagtcgtatcttgcttcggaagccgaccggttgtgggtatccatctatgacggattttcgcggatggctgttcctctgtttatgattgtatctgcctacctgcttgccccgatgaaggaagggcaaacgatgggacagttttaccgccatcgttttgctcgtatcttgcccccgtttgtgatattcatggtgttgtatagtacattgccgatgctgtggggacagatcgactcggctacgtcggtaagggacttgtcgcgtatcttgttgaatttccccacactggcaggtcatctatggttcatgtatccgctcatcagtctgtatctgttcattccgatcatttcaccgtggctcagtaaggctacggccaaggaggaacgcttctttgtcgttctgtttcttgtgtcgacctgcattccctatctgaatcgcttctgcggtgaagtatggggacagtgtttctggaacgaatatcatatgctgtggtacttctccggatatttgggctatctggtactggctcattacatacgtgtgcatctcacgtggaaccgttccagacgcttgtccgtaggtatcgtcctgatggtggtcggagcgctgtggaccatctattcgttttatgtacaggcagtaccgggccagattatcgctactcccgtgctggagatcggatgggctttctgcaccatcaactgtgtgatgcttacgacaggggtgttccttattttcagtaccattcaggctccttcggctccgcgcttggttactgatatgtcgaaattaagttatggcatgtatctgatgcatatcttctggctgggattgtgggtaacggtattcaagcagacgctggagtttcctaccgttgctgccattccgtgcattgccgtcagtacctttatctgttgttatatcacggccaaagtgatatcattggtgcccggaagtaaatggattataggataaacaactaattactatagattatgaagaaaatttggattttgttgataggcttgttggctggtctgcatctcgaggcaaaagagaacgagggcaccaatgttgcttatcaggatggaaatgtccggtttacggttatcgatgagggtgtgattcgcttggagtggcatgccgatgctcagtttgtcgatgctgcttcttttctggcagtcaacagaacttacgataaggccgattatcgtttgtctgagtcgaaaaactgggtagagattgctaccgataagatggtgttgaagtataagaaaaacagcggtcgtttttctgcgtcgaacctgagcattcgctcaaagaacctgacgccggcgtttcagtggaagccgggggatgtcaatcagggcaacctgaagggtacgtaccgtacgctggatggttacaacggtgaaatctttgtcggcaatggaaacgataatggagaccaccgtccgatgcctatcgaagacggattgttgtcgaccgatggctggacgctgctcgacgattccaagggatttctgttcgacaattccgactgggcgtgggtagaccagcgcaaggggagtgatcaggatcaggactggtatttcatggcgtatggacacgattacaaagcggcattgaaagactttaccgtctttgcaggtaaggtgcctctgcctccacgttatgccttcggttactggtggtcgagatactggagctattcagacgacgagctgcgcgacttggtcaacaagttcgaaacgtataagattccgttggatgtgctggttgtagatatggactggcattacgtgaacccgggaagaggtggatggacaggctatacgtggaaccgttcgctgttccccgatcctgccaagttcctccacgatgtgaaaagtaaaggattgcaggtaacattgaatctgcatccggctggcggcattgaaccgtacgaggagaaatatcccgaaatggccaagtggatgggcatgaaccctgacgaaaagaagcgcatcgactactgtggctccgacaagcgtttcatgagtggatggctgaataccatcttgcgtccgatggaaaaagaaggtgtcgatttctggtggctcgactggcagcaggatatgttcgatgctcgcatcaagaatttgaacaatacatggtggctgaactatgtctttttcagcgacatggagcgtagccgtgatacgcgtcctttgctgtaccatcgctggggcggtctgggcaatcaccgttaccagattggtttctccggtgactcttacagcacctgggagtcgcttgccttccagccgtatttcaatgctaccgcatcgaatgtactctatggttactggagtcatgacctgggtggtcatcagtttgcaaagggagcgacacagctcgaccgcgaactgttcgtacgctggatgcagtttggtgcctttagtgccattatgcgtactcactccatgaagagtgctgccatgaacaaagagccgtgggcgttcagtcaggagtatttcgatgtattgcgtcagaccattctgatgcgttataaagttgctccttatgtatataccatggcgcgtaagacttatgacgacggtatttctctgtgtcgcccgatgtactacgattatccggatgctcaggaagcttactctttcaagggacagtatatgttcggcgatgacatgctggtagctcctgttacttcgccgatgaaagagggctatgctactgtcaaggtttggctgccggaaggtaccgactggtatgaatgggctactggtactcttctgaagggaggacaggtggtagaacgtgcatttgctctggatgaatatccggtatatgtaaaggctggagctatccttccgttctacggtactgtgaaaaacctgcgtcacaacgatgaggctgtacgtctgaccgtattccccggtggcaacggttccttctcgttctatgaagacaacggcaacgaccagttgtataaagaccagtacgcgcgtactcagttgtcttccgaatggaaagaaaacaagctgacagtccacgtaggacagcgtaagggctcttataaggacatgccccagaagcgtacctattgcgtcgatgtagtagggtcggttcctgccgataaggtgttggtgaacggaaagcctgttgaggctgaatacgatggtacatcccttacactgaccgtcgacctgcctgcatgcgattgcacaagcgactatacggtagaagtattctacaaggccggacagccggaagtaaacaacggcttgtatggtcagttcaagcgcatgaagaaaagcttcgtagacatgcgatacagaaatgcaagcatcgattatattcaggaactgggtgatatggaaactaccggcagagccgttacctatcatacagactcctttgccgataagatcaggcagtatcaggcaaattatgccaaccttcccgagctgctgaagaaacagggcttgagcgataacgatgctcagtggttcttgcagtcagtccgttgggagaagaaataaggctgtacagcaagattatcctaaaaaaagaaccctatcattctccgaaatggagtgaatgatagggtttgtttattgtaagataatcaagtatcggtttatctttgctacgtccgttacaggaacggagaggccttcttgagggttcaagccggagctttattcctcgttcagcttttcgtcgatagcttctatctttttcaggacgagatccatttcccctttcaggcgttcaattttccggttaatctcagtaaccagcgtgttgcccttcttcgaagccgatgacaagaatcccaagttgttttcgtaggtctgaatatcatttttcaatccttcgtacgtacgcacaagcttttcgcggtcacggtacaagttatcacctttggcaagtcccgatttgaagttgctgagcttcttttcagaaacagaaatattcagtcggtcgaacaatttatcaatcagaccgtggaattcgttatacagacgatctttctccttaaacggtacatgtcctatgccgttccattccttcatcagggagcgaacctgttcggctgtagtatcatcagtagctcccgaagcattcagtacggcgagctgcttgataatctcttccttcttcgccatgttctctacttccacagagcgctgtgaagaagtagccttgttcttctgtgcgaagaaatagtcgcatgccccgataaagcgtttccatacagcgtcggagtgctttttggcaaccggtcctatggttttccattctttctgcaacttggtcagaatttcagccgttcccttccagtctgtactgtctttcagcgcttcggccttttcgcacaaagcctttttcttttccaggttagcagccatgttttctttcaccgacttaaagaaagccgccttgcgtttaaagaactcatcacatgccgcgcggaaacgctcaaagattttcacgttcattttctgcggtgcataaccgatagtcttccatttagcctgtagcgcgaggatttcctgcgtcttgtcctcccagtcggcaaaggtcttgaacgtatcatactccatagcttccactatttcacagatcaccgtcttctggtcgaggttgttctgttccttttccttcagtgcctcaaagtgctgctggtgccggcggtttaccaccgaagaagccgctttgaaacgtgcccagatactttcacgcaagtctttggctacggggccgatgttacgaaattcctgatgcaatttctgtagctgatggaaagcagacactacatccggttcgtttgccagcttttcggcagcctcacacagataggttttctgttccagattctttttgaagtcatactcgcggaattcattgttcagctttaccatgtcgtaaaacttttccgtgtacagctgatatgttttccacaattcattgaccttgcccacaggtacctgcttgatttcgttccactgctgttgaagttgtttaaattcgttatagatcttacctgtgtcttccgtattgtcaatcagagccttcatcttgtcgagtatgtccagcttcttttgcaggttagcttctttttcctgctccagttctgctgccatcgcactacgcttctctttgatggaactcatgatttccttgaattttgcttccaacggattagggatgggagtaaattcttctggatttccgccttgctcaataaagtttttgcgtgccgtatcttgctcggttttatgcagtttgtaaaacatttgtttcaagtagtctatctcctgtttgtcagcttcacaggcgttgtcgttgagttctgtcagacgtgttataacttcttcctgagtatgtacgggagaaaattgcgttttagcgtcattctcaacagaagaaaccgaagtttcgggagtgtctgctgccggaatttcagttaaagggcgggttgtttcatttacttccatcgtatttagattttaaagaattatgtcagcttatcttagtccgtagttgcaaattaaaagaataaaatctgattttcaataatttttcctaaatttttttttgcaataaagacgatttttatgaatttctttggaaaatatagggcatggaggtcataaagattaatagacctccatgtatgattgggaaattggatattttaagacagcagtacagttattcccatgtacatcatcatgccgatgatgtcgttggtaatcgatataaacggtccggtagcaatcgccgggtctaccttcagcttttccagcgtcataggtacgagcgtaccgaagattgatgcaaacatcactacggcaaacaggctgatggataccgagtagctcaccgtggcggttgcgccgaagcggataaaattataaatgtataccagcattgaaatgatggttgcgttgatcagggctacgacagattctttcagcacctgctggagagtgtttcccgagtcgagcgagctgttggccaatccttgtaccacgagggccgacgactgggttcctacgtttcctcccgtaccaccgatcagcgggatgtacagggccatttcgggatgtgcggcaaaggtcgagtcgaagttgcccaagatcatggagttgcctatacctcccagcatcccgatgagcaaccagggcaggcgtgccgttgtctggcggaacacgttgtcgtgcgattctacgtcctgcgacaaaccggatgccaactggtaatctcgttcggcctgctcgcgaacctcatccatcacgtcgtctaccgtgatacgtcccaccagtcgaccgatgctgtcgactaccggcaccgctacaaggtcgtacttttcgatgacctgcaccacctcgtccagcggcgtatctacatgtaccgaaatcggatccttcttcatcacgtgctttactttcgagaccgacggactggtaatcatttttttcagcgggaatacgcctcgcagacgttcgtcatcgtctaccacatatacgtagtaaatctcgtccatatcctccgcctgtattctcatttcgcgcagacattccggcatactccagttctcgtttacgatgaccatctccgtacccatcaaaccaccggcagtatcttcgtcgtacttcagcaagtcgacgatgtcacccgcctgttcgatgtcttcgatgtgtgaaaggatttcctcctgtttgtcctcgtccatgtcacggataatgtctactgcatcatccgagtccatgtagtcgacaaaacgcttggcgatggtttccgacggcaggacctcgaggaatttcttacgcgcatcctcgtccatttcaatcagtacatcggccgccttttcgttgtcgagaagcaggtagatggaacgcgcctcttccgcatccagctcgttgcacagttcggcaatgtcggcaggatgcaagccttgcaggagttccttcagttcgtccgatttcttctcctcaatcagttctgatacttttttgatttcttcgttttccataccttactcggttgcgagtgcctgttccacccggttggtcaattcgatgaagtctgctaccgacagctgttccggccgtttgttgaatatcgggtctgcactgagcgggttccctttttccagtatcggagagattgagttgcgcagggtcttgcggcgctggttgaacgtggttttcacaatctgcttgaacagcttctcgtcgcatcccagctccgtggtttcgttgcgcgtcatgcgtatcacggcactcttcaccttgggaggcggattgaacacatgttcgtgtacggtaaacaagtattccaccttataccacgcctgaatcagcacgctcagaatgccgtacgtcttgcttcccggaccggcagcaatgcgttcggcaacctccttttgaatcattcccgtgcagcagggtatcagatctttgtagtcgagcatcttgaaaaaaatctggctggagatgttatacggatagttccccgtcagcacgaaaggctgtccgccgaagagctctttcaggtccatcttcaggaaatcctgctcgatgatgttgtcgcccagttgcgcgaaattctcccgcaggtaagctaccgattcgaaatccagttccaccaccttcaccggtcttcccttggggatgaggaactgtgtcaacacacccattcccggtcccacttccagtatcggcaggtcggggcaggtatctaccgtatcggctatgtctttggctacttggaggtctttcagaaagtgctgtcctaaaaactttttcggtttaactaatttcattccgtatgtattttctcgatataaataaagaattattccagcaagatattatctttgcatcgtgcaaatttaagcattaatctttaataaacgattacgttttggaacgaactgatataaaaaagctcataaataaggtctttcaggtagctttgcctctcatgctgggagccgccattttagtatggacgtaccacggattcgacttccggcgtgtgtgcgaagtaatggatggaggcatgaactacgggtggatgcttttttcgctggttttcggtgtcttcgggcatctgttccgcggatggcggtggaacctggcgctggcccccttgggcgaatatcccaaacgctcgaacagcgtatatgccatcttcgtcgcctatgccgtcaacctgattctgccgcgggtgggagaggtttcccgctgcggggtactggcgaaatacgataacgtctctttctccaagtctctgggaacagttgtttccgagcggctggtcgattctgtctgtgtgttgctcattacggcaggaaccctgctgctccagacgggtgtctttgcccgcttcttccgcgtcaccggaaccgacggcgccttctttcttcacctgttctcgtcgactaacttttacatcacccttgtctgcattgttgctgcactgatcttactgtgctggctggtacgcaatctcaccatttttgcgaaagtgaggggcatgctgaaaaacgtctggctgggctgcctgtccatccgcaatgtcaaacatccggtgctgtaccttttctataccgtagccatctgggcatgctacttcctgcacttctatctgacgttctactgcttcgacttctcggccggactgggctgggctgccggcatggtattgttcgtggtgggaagtattgccgtcatcgttcccacccccaacggagccggaccgtggcattttgccgtcatcaccatgatgatgatgtatggcgtaagtaaggaagatgcaggaatatttgcacttttagtacatggtattcaaacctttttattaattttgttaggaatatatggactggtggctttgccgcttacaaataaaaataaaactaaaacctatgagtgaaattctttctctgactccacagaatgtgtggaagcatttttatgcgttgactcaagtgcctcgtccttcaggacatctggcaaaagttcagtcgttcttactggaatttggcaagcaagcaggtgttgaagcttttcaggatgaggctgggaacattatctatcgcaagcctgccactccgggtatggagaatcgtaaaaccgtaatcttgcaggcacacatggatatggtgccgcaaaagaacaaagatacacagcatgacttcgaaaacgatcctatccagccgtacgtagacggcgaatgggtgaaggcaaaaggtactacactgggttccgacgacggtatgggcgtagctgctatcatggctgtgatggaagacaaaaccctgaaacacggtccgctggtagccctgattactgccgatgaagaaacaggcatgtacggagccttcggtctgaagccgggaaccatcgaaggcgatatcctgctgaacctcgattcggaagaagaaggtgaactgtatatcggctgtgctggtggtgaagatctgacagctacactggaatacaaggaagaagaaaccgatcccgaagacgtagccctgaaggttactctgaaaggtctgcgcggcggtcattccggcatccagataggctggggacatgccaatgccaacaagctcatggcacgcttcctgaatcaggtcattgcctacgacgaggcttgtctggtatcgtgggaaggcggtaacatgcgcaatgccattccacgtgaatgtgaagtggtaattaccgttcccgaaacggaagtagacgacgtactggcattcgtaggcgagtgcgaacaggtatggcgcgacgaatttgccggcatcgaagaagacctcagcttcaaggcagaacgcgtagctctgcccaagtatatggtaccggaagaaatccgcgataatctggtagacgccatctacgcttgtcccaacggtgtagaacgtttcatcccgagcattcccgatacggtagaaacctcatccaaccttgctatcgtcgaaatagccaacggaaaggcagctgtcaaggtattgacacgcagtgctcgtgaatcgatgaaggattaccgcaacacagccatcgaaagctgtttctccatggcaggcatgcacgtagaacgttcgggcagctattcaggctgggaaccgaatgtaaattctcctatcctgcacgccatgaaagaagcatacaaggctcagtttggcgaacagcctgaagtgaaagtcatccatgccggactggaatgcggtatcatcggagccattatcccgggactcgacatgatctccttcggacctaccttgcagtgtccgcatacaccggaagaacgttgccacatcccttcagtagccaagttctacgacttcctgactgctacattggcaaatactcctgaaaaataattcctgacggatacacataaagagggctgcttcaatcattcagttgaagcagccctcttgctttatatatcctccgtattttcacgttcccatacggtggatactcctgcgtaaatttccttttagttcatcgggctgaatgaaaacagaatagagtactgctcattttgccaatcgtagtaagtacctatagcacctttggtcttattgtctttagacgtaaattgacagataaacatcagcgccttattttgcataaggctaacgattaatccgtccggatccagattttcatattttgtttccccgttgttcatcttttcgaggcaactcattatcgcattcttttcacgttcactaaagcttacattcgaagtgttataaacatactccgagcagttataatcttgctgcatataatggatacgctccaagaaatgagtgaaatagctgctttcactttgatcctgtggtgtacatatatactcaatctgattcaacttgttgtttgcgtcaaatttataagaaacatatctgtttgctttaagatcagttgacgcagaactcgactgcgtaaaatcctgtttagcctcactcgaataatctacatctccataaatatcatcctcaacgatgttgatggtgccatcagtcgatattgcccgtgttgtgtagtgcgacagattctccatggtttcctcccgcgtgtcataccagaaattacatctgatgtccgaagcaacgacctcaatctgtttcgtctttgtaatcacttgctgagtagcatccccagtgaataatccattgttgatagccgataaagtgatggtatgctttcccggtgtcgtacaataaatttcagccgacaattcaccgtttatcgatttgatagtagtcggaagcttgccgtcgatagatacttgaattttttcggatgccaagccacttccgggaacatacgaactcgaaatagtaaaccactgatgcgtaccaatctttgtacgatctaccgagatatctcccagttgacccgccgtagaatactgcgtatcatcttccgaagaacaggagaacaaagaaaggcttgccataaatatagccagacaagctgaaatgttgtgattctttttcattttattatgagtttattgtgtttctttttctgaacgaatttgcatatatctgcaaagtatctgttttctcatggaattacaatatacacattttcacgatatgctaccttcttttttttcggtaaatacaatttttagggtacaagttaagacttattttgatcaatcgtgaaattgctgtaaaccaatcaacaaaccgaaatgatgttcctacaactcatttattatttcttcttccgtcagccccgtggcttgtacaatctgtgccgtagtcagtcccagcgatttcaggttacgtgcaatagcgattttttcttccgcacgtccttccgcacgtccttctgctcttccttctgctcttccttccgcacgtccttctgcacgtccttcgcttctaccttttgctctaccttcttccagcccctttttccaaccagcttcgcgcgcatcctcttctacgatccggctcacacggtagcgatccagcgccttgtcgtaggcaatgcggtcctccatcgagaggttagccacagcggcaagctcctccagacggttgaaaacctgttctttcaacgcatccggcattcggttccaatgttgcatattcttcagtgtataaataagtttgtcataaagagttttacagtccttaagctccttggtgaaatacgggaactgaaggaaaatctgccggaagtgcgggttcaccaccttaccgttttcccggtcggctataacagtatccgtacggaacttttcttccagtcccggctcccggaagttcataaggaagataccgtataccgtcgagagcctgtatctggccccgtagttttcctgcatcggttccctcagccaaaaatcatcttcctcctcctcgtccggctttcccattttcagttcacgctcttttctcctcttctcgcgcaagttctccacctgcctgccgatagccctgcacatatagaacagtgtgcggtccagaaagctgctgtggaaccggttctgcatctccacgatgatatattcccccgtatccgtcaggcagtacaggtcgtagatgatccccgcatctgccatgctgtcagagtgattctccttatccagaaaaatcaggttctcgatacgatgctctcccgccagcagttcgttcaggagcgtgataagcaattccttgctagcaggctgtccgaatataattttgaatccgatatcggtaaacgggttcacaaagtgcccgcaagtcaaatccataccgtccatatttcctcctttccgtgtttcgttttacaaaagaatttcctcagcgttattctgtcatcagatcatgctttgtttccgatagtcacgcaatccgttcatatccggttattccttgtcaattttctgatatcttcctccgtcagcctcgactgtttcaggttgcgtgcatgcatttagtagttgataattacaaagtaagcaaataaataccgaaactacaagccgatacaaaaaaatcgccacgatactccgcatagcgtgtaccgtggcgatttcctgtataaaatatccttttagaacttccgtaacttcagcagggcatagtccgattccagggtcatgtacttgccgtcgcacgagctcacgttgaacaccgtttccgcctgattgtcgataccgaaatgccgcagcatctccaccggcgcatcctgcttgttgtcgctcgtgttggcacgtaccttgaaatccttcagcaccagctgcgtctcgttgttgcggtactccgtacgcccgatgtaactgccgtagccgttcggcccctgcttttccgacacttccgtcaccatgcgcgtaatgctgtaatacaagcgctcgcacgtcaccacctcacgcgtatccttcaccatgaactgctccaactgccagaatccctctatatcgttgttgataggcgccttctgacaaccctgcatcaccagcgccaccaccagagccatccaaatcatcaccttgtttctcataatccgaatcctccacattttctgattgtcaacataccacccgtactgtttcccggataatttccacggtcaaccgccagagcagcactgaaactccatcccttcagacgttcaggccgataagtcacctccgccagactgctgaactgcttcttcacctcgtcgaaaggctttatatacgatccccagttgcgggcatacgaaaccagcaatctccagttccattcctccgacggatcacccgtcagtcctacatgctgagccttcacccggcaacccttcacctcgttcacaccatccgtattatacgccggtcccggcaggaacggatgtcccagcgagttcccgtaattctgccagcctaaatattctccatttgtataataattatcgcgaccactcatctgcaagtcgttgaacgaacccgctatcccgtcgtagagaatcgggcccgtctgatccgtcgtgttcagaccttcccacaccacggcactgatccatcggttcttcggaaaatccacttccacgccgatgtgaccatccttccatcgtccgtactgccagaacatctgcgagtgatcctcgaaataatgctccagatatgccttaaacttccagtcgcccgcatagtaattcagcgcgaagttccaacttccgcagtggtttccctccacgttctccagcgtactttcctgcttggggaagaacaccttccagaaatccttgagtccctgcggcatatctcttaccagactcacgctaccgtccgcattcttctgcatccgcttgccgccgaattgtgctgccgtcagcaaaccaaattcaaagtccaccggcaacttctcccggttacccagtcggatcattagcgacttgctgtgatacagcacccccgtcgtataaatctgtcccggagccacaaaatcctcctgccagtcgccgtcggtaaaatacccgtaactcagataccccttaaaggccatccaacccttcgtacccggaacgttcaggtaatccttcacttccacccgtacctgcggaatcggcctcatgttcgtaccttccaccatccagccactggtcagcttctcgttcttcgcgagcggaaaccccggccgttccttgcttccgatactcagcgtcagcgtcttccacgacacatccgcataagcctgctgcacccaaaacttcgacgacaggttctttccttctgccagatccattcctgcgtcaatccgccagttcttcggcaacaccttgttccattccgctccggcacgcacatacgcaaagttaggctcattgcccgccacaccatagcggttggccgtcagccacacaggagcataatccccgttcgataccgccacacccgcttccaccttatacttcagcgagtcggcaggctgctgcgcataaagcggactaaaaagtgtagtcagtaataaagtctttatcagtttcataccattttcgttagagagttgcaaagaaagtgaataaatggtagactggcaagtctagcgcctatagttgttctatttctttggcagaaagtccggtagcagcctgaatctgttcagtactcagtcccagagatttcaggttgcgagcaatagcggtttgtgtttccgcgcgcccttctgctattccttccgcacgaccttccgcgcgaccttctgcacgaccttctgcacgaccttctgcacgaccttctgcacgaccttctgcacgaccttctgcacgaccttctgcacgttccgtcatgatattatcccgcagaattacgatgttgtccagatgcttgtaatacgcgttcagctcctctcggctcatgcggtccagcttcaactgttccttcaccttgtccagtcccggtgccgtggcatgttccggcacgtttcccgtgttcaggtaataaatccactcctccagcggcgtttttgccacccggttgaagtcattcaccttcaggatataatactccggataaagctggctcaccttgtccaccttgaacgtctgcttctggaaggggctcagctccagcacatccccctcgtgaatccccacgaactccgtcttcccgtgatacacgaaatccttgccgtgtcccagcgagaaatacacgatgttcacgctgtacaccttgcgtaccttgtcgtacccctgtccgcggttgatatactccgtcaccagcttcgaagccccgaacagcatccgctggaaatacgcatactcattgttgttctgcacctcgatgagcaccagttcccctttcgagttctccgccagcatgtccacgcggttgtacttgtcgaactcatcctcctgattactttcactctccagcagtttctggatcgtcaccttttcttccagcagcgtagtgagcagtccctccagcaccgcatagttggccttgttgcgcagcaggcgcttcatcgcccagtcaaaccgaatataactttccataggacaatttttttatcatattatcacgtgtgcaagttacaatgtttttaggaaaaaacaaatatttgctatatcttctccttgtttaataatttgtccttggcaagctgaaccttacgcaaggcttcaagagcctgctcagatcttttccggtcaatctgtaaatgcagatgacaggcagggcatacccgcttgccatccaaggtcttgtcgaacactgtcctgttcttaatgatcgacttaatctgtcatggggtaatatttcccgtctattatagagaagcattgacggtgttgctttactccgtcgggatgcttgtagcccacgtgcatccagctgggcataccgcttttgtcctcaccttcggaaattaactggtcgaaagctttgtcggcaaggaatttccggcagaaacgtttgaactccctcatctttccgtttgtcggcacgaggtcgaaggcgtatccgtggcaatgtgctgaagtggaagagccatccatttccctgtttagctccggtccacggtagccggaagagatacggatgtctaccttgcccagattgttgcgggtgcaatagtcgtcccatgcctcgcacaaggggtcgatcagtgtttcaatggattctacgatgtgggcttctatttcgggtgacggtgtgttgttgatgccctttgctattgctgttgcggaatacgtgcattcctccaatgtaaaatacttcatacgtttttatgtgttaagtttatactatccaaagttctttttgtaaatcctatgaatactaggatggcagtttcgtttttttctctatgctgatacaattttgcaacatttgtttacttatctcggtttggtgaatccaatgaaggcacatctccttaccatattggtgatatcttctccagcgatgataaatgaggcggtttcaccggtaggcaagaagcctccgtgcgaccggcctttccagccaccgaattcagtatattggcggtcgaagtccttgttttttgcaaaaaaaatgtccaatgcttgtggacggatataataactgttggctttcgcccttatcacatctgcttgttggtcatgtcctgtacggattaattatttcacattcacaccttcgtgcgcaatgaccaaagtctcgatggaggtcgtgttaccatcggtcttgaaaccttctatggtaagctttttgggccatgcgttcaccgcctcccaggtctttactgggctgcccgattcgtccagcaggctgactgttacctcttcgcgctggatggtgttcagtttcaccttattgatccagtcccatagttttttgtcatctttgcagatacctttcttgatggtcagatcacccgcttttctcagtcccggcattttcagtttagtgaacaccggactgtcgcctgcgcgataagtgatttcctcgtattccgtttccagacccgacacttcgctgcaggaaatatcgcctacgttcgagatagatactttgaaataaaaactcggcaaaggccatgcttgtgtgcttgcaccttgtgctgatccattctctgccatactattttagtttatcatttaattgtctgtttttatcagcttttctgcatctgttgctggaacgtgatttcgatgaattctgccggacggctgatggccaccagtacggtgacgcgcaggataccttccagtatgtcatcgcccgtcatcgtatctcccagaccaacatgcacctcgtatgcctcttcaggggtcgagccggccagtccgccacgtttccatacactgcacaggaaattctcaatcatgctcttcatgttgatccaggtattcgcgtcgttcggctcgcacacgtaggcccgtgcggcgttcttcaccgaaatttccaggaaactcatcgtgcgtcgcacgttcacataccgccagtcctgcgagttgccgtccaaggtgcgtgcgccccataccttgatcccttcgccggggaatgcacggataacgttgatggcttttccgttcatcggcatgttatagtcttcctgttcccggtcagtgataacggtcgacggcttgctcacgtaattgatggatacattggcaggcgctttccatacgccgcgggtatggtctaccatcgtgtatagtccggccatggctcccgaaggcggaagcaggttcaggtagtccttgactttcttttccagcagattgtatgcaggaaggttctgcatcagcgcattgtgcaggttgttgcggtgcaacggctcattgttgtcattcttctttatttctgcgatttctccttgaatataggcatcaagctgggcattcccggttttaaaatcttgggtgatgtccagtttcatcacttctccgtcaatgtcgttgtccgacaataccgtcgtttccagccacggataataggctgccccataggccagaaaattgctccccatcttggtgcggaagtcttccttcccgttttggggcacatccagaatggcaaaacggttgtttgcggcgcagtgtgacagcatggccgtgtagaagtcggcatattcccctgtttccaccgcttcgggaatgacgagtagagtaatttccggttcctttgtcagggcaggcaataccgtattattcacgatatccttgtcgagggtacccgtggcataatcgcccaccgacacaatgtagcaggtgccgccgccgtttgcaaagaacagcttcaggtgatagtacagcgtacagtgtttgttattcagtgtcgcctgaagttttttttctccatatctcactgaaactgtggcagcttcattgtctgcatccgctacaattatgtcaaagcggtgtatctgcggtcctccgaaatactgcttatattctgtcatcgacgaaatccggacaggtttgtttttcagggattccgttccattctgtgctttctcggtcagcccaatgaacactgggatggcagtttcggcttccactacggagtttccgaaagcgtttttctccttgatgtaaacgccgggtgtcttgtattcactcatagtttctattttaaatgtttaacatccggctggagtacatgtctctgcgtctcttcatttacgcttgtctgttgcagtagttgtgttgaatccggatgcggtataatatacggtagctttccgtcgatgtacgttttaagttacatatcactggtgtttcctattgatcccacgggagccagtccttcgggttggcggtggaatgctgaaagatattcttccagctgtgatgcgtatgtagttagtatcttgtttatcataatgactgcaatttacggttttctcgtgaaaggaacaagtgtttaccgcctttttgtaagcattcggtgaactacgctggtacaaaaaaatcgccacgctaccctccgtatagagtaccgtggcgatttccgtttactttcccgccgcaaaatccttgatgcgctgttcctcactcagtactacgcaactgctgccgataatcaataaaatgcaagctgatatattcgtcgacaatcaaccattagacttacaatgtttttgcgaagtccttcaaattaattatggcaactgatgggaaagatatatttttaagttcattgaaatggtgatcctccgtcacgatatattccgcattggctgttatggcacagtctacgaacttattgtcatcctggtctgctgtaattagatgaaaacggtagtgaggagttaatttctttacattttcacgagtaagaatcgtgtagataatcgtttcggctacatacttattaatgttgcgagtcatgacttccagatactcttctacgatttcattgcttatacataacgtatagtctccattcaagaatgattgccacactttatggcagtcattcttcgctgaaattgcaataatctgtgagtttgtatccaatacaatgtttctcatattcatttatagggagtacgttcatgtagttggtagaatttatcgactttttcctcatttaattctccattctcccacaaacggtcaatttctttttgcgcttgcttggcgaaatagtcagaaatagcctttttaagttctgctaatgcttcaggactatccacaaacgacatcatttcaagcacttgcaattgagccggattaaaaactgtagtattcatatatttggatttggttctaatacaacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgaaataacaaatggaagattatttcttttaaaaaactataaattgtagaaagcctcgatttcgttggtcgataatatttgccaattagtcggattaatatggctatatgtaataactggcttgttttatggttattgttagttaaacggtgctttttttgaccgattttttcattatatttgcatggctaaaaactaaacatgtcgaaaaagttttcttatctgaagtagagagtgtaaaaaagtgaaaaacattaattattataatatgaatatgaatgtaaaaagaaacagaagtttttcttctagccggattgcccttatggctttaggggtatcggtgttgactgcctgtggcggtggccagggcggtatgaaaatgggtgataacgaatttgctgtacaaacggttacaacaacttccagtaatcaatccactcagtatccggctactatcaaaggcttgcaggatattgagattcgtccgcaggtatcgggctttattgtgaaattgtgtgtcgatgaaggtgccacagttcataaaggtcaggcactgttccagattgatcctactcagtataaggctgcatacgatcaggctaaggccagcgtagaatctgcaaaggcaaacctgaaaaccgtttccgaaacagaagcgaacaaaaagatgctgcatgaacagaaaatcatcagcgatttcgaatatcagactgctatcaataatctgttgactgccaaggctagtctggcacaggctgaggctgcttattcggctgctaagcagaacttaggtttctgtacagtaaccagtccgtcggacggtgtgatcggaactttcccgtatcgtgtaggtgcattggttagtgcttcaatcgcagagccgttgacaactgtttctcagattggtgatatgtatgtgtatttctctatgacagaaaaacaattgctggctctgacaaaggcaggtggtaccttgaaagaacagttggaaaaaatgccggcagttaaattgcagttgtcggatggtacaatgtacgacgctgaaggtaagattgatgctgtcagcggcgttatcgaccagagcacaggttctgtaagtatgcgtgctattttcccgaacaagcagaatatcctgcgcagtggtggtatggcgaacgtcgtattcccttacgctatgaataatgttatattgcttcctcagtcggctacacaggaaattcaggacaagaaattcgtgtatgtcttgcaggccgacagtacactgaaacataccgaaatccaggtttccaatttgaacgacggtaagaactatatcgtaaccggcggattgaaagaaggcgataaggtagtagttgaaggtgttcagactttgcaggatggacagaaaatcgttcctattactgtagctcagaaagaagctaagtatcagaaagccctccaggatcagcgcgatggaaatatccagactgctttcaattgatttgtgtgaggtgaacaatttattcgtataatataatattattcaaggaatagaatgaaactagataaatttattaatcgtccggtactatcaacggtaatctctatcttgatagttattctgggtattatcggccttgctacactgccggtaacacagtatccggatattgcgcctcctaccgtatcggtaagagctacctatacgggtgccaacgcgcaaacagtattgaactccgttattgcaccgctggaagaccagatcaatggtgtagaaaacatgatgtatatccagtctagtgcgtcgaataacggttctgctgatattagtgtatatttcaaccagggtaccgaccctgatatggcagcggtcaacgtacagaaccgtgtttctatggcacagggtctgttgcctgccgaagtaacaaaagtcggtgtcactactcagaaacgtcagaactctatgttgctgatcttctctctgtacgatgcggaagacaagtataacatcgagttcattgaaaactatgccaagatcaacttgattccggaagttcagcgtgtaaaaggtgtgggtgatgccaacgtgatgggtcaggattattctatgcgtatctggctgaagccggatgtcatggcacagtataagctggtaccgggtgatatttccaatgcactggctgaacagaacatcgaagcagctccgggacagtttggtgaacgtggtaaccagactttccagtatactatccgttacaaaggacgtttgcagcagacagaagaattcgagaacatcgtcatcaaggcactgcctaacggtgaggttcttcgtctgggggatgtagcccgtatcgaactgggccgtctggcatatacctttaataatacggtaaacggacataaggctgtaacctgtatcgtattccagatggctggaaccaacgctacagaaaccatcaacaacttgctggatgtaattcataaagcagaagaaagcttgccggcaggtttgaaaatcaacgtggctcagaatgccaacgacttcttgtacgcctctatccacgaagttatcaagactttgatcgaggcatttatcctcgtgttcatcgtagtatacgtcttcttgcaggatatgcgttctactttgattccggccatcgctattccggttgccttgattgcgacattcttcgtcctgaagctgatcggatttagtgtgaacttgctgactttgtcggcgatggtgcttgccattgcgattgtggtcgatgatgccatcgttgtggtggaaggtgttcatgcgaaactggaccagggatataaatcttcccgcgaggcttctatcgatgccatgagcgaactaggtggtgcattggtttccattacactggtcatgatgtccgtgtttatcccggtaagtttcatgggtggtacggcaggtacattctaccgtcagttcggtatcaccatggcgatctctattgcattctccgcattgaacgcgttgaccttgtcgcctgcgttgtgtgccctcttcctgaaaccgcacgattcagaacatcagcctaagaagatgagcgtggtcgaccgtttccatgcttccttcaacgccgcatacgactctttgttgaagagctataagaaacgtgttgtcttcttcatccacaagaaatggctggcattgggaatggtagcagcttctatcgttctgctggtattcttcatgaagattactccgaccggtatggtgccgaacgaagataccggtaccatcatgggtgctgtgacattgcctcctggaacttcacaggaacgtgccatggaagtattggccaaggtagacagtctggtagctgccgaaccagccgtacagtcacgtactattatctccggttatagcttcatcggtggtcagggaccttcttacggttctgtcatcatcaagctgaaagactgggaagaacgttcattgatgcagaattccgatatcatttatgctacgttgttcatgcgtgcgcagaaagtcatcaaggacgcacaggtattgttcttcgctcctcctatgattccgggttattcagtatcaagcgatatcgaattgaatatgcaagataagaccggtggtagcctggatcacttcttcgaagtagtaaacagctataccgcagctttggaagcacgtccggaaatcaactcagcgaagaccaccttcaacccgagcttcccgcagtatcagttggatatcgatgcggcagcttgtaagaaagcaggtatcagtccgagcgacatcctttctactatgcaaggatatttcggaggtctgtacgcttctaacttcaaccgtttcggtaagatgtaccgtgtaatgattcaggctgaacctgacgcaaccaagaacatggaatcgctgaacggagtaaaggttcgtggaagcaacggagaaatggctcctatcacacagtttgtcagcttgaagaaagtatacggtccggatatcatcagccgtttcaacctgtatacttctatgaaggtcatggttgctccggcatcaggatatacttccggtcaggctttgcaggccatcgccgaagtagcaaaagaaaatcttcctaccggattcggctatgaactgggaggtatggcgcgtgaggaagcttcttcaagcggtagtactaccggtatcattttcgtgctctgtttcgtattcgtatacttgctgttgagtgcccagtatgaaagttacatccttccgcttgccgtactgttgtcagtaccgttcggtttgatgggtagcttcctcttcgtcaacggcttcggtgcactgggaagcattccggcattgaagatgatcgtaggatccatgtcaaacgatatctacatgcagattgcattgatcatgttgatgggtctgttggcaaagaacgctatcttgattgtagagttcgccctcgaccgtcgtaagcagggtatgagtatttcgtgggcagccgtgttaggtgctgctgctcgtttgcgacctatcttgatgacctctctggcaatgatcgtcggtttgcttccgttgatgtttgccttcggtgtaggtgctcacggtaaccgtacattgggttcttcggctatcggtggtatgttgatcggtatgattttgcagatcttcattgtccccgtattgtttgtgatcttccagtggttgcaagagaaagttaaaccgatggaatgggatagcctcgatgaaagcgaagttgaatctgaaattgaacagtattctcctgctagtaaaactcataaatgataaagacgataatgaaaaaacaaatattaggtgcaatgtgtgtagctgccatgatgagcagctgccacatttataaagcttatgatcgtccggaatcgatagatgcttcaggcatctatcgtgatccggcctcggcgaccgatacgttggtctcggatacggccaacatgggaaatctgccgtggaaagaagttttccgtgatgccaaactacaggctttgattgaagaagggctggccaacaacgtagacatgcaggccgctattctgcgtgtagaagaagcaaaggtgatgctgaccgctgctcgtctttcttaccttccttccatcaatctggctcctcagggaacactgagcagtttcgataagtcgaaacctacacagacttaccagcttccggttgccgcaagctgggaaattgacctgtttggcaagctgctgaacgcgaaacgtggacaacaggctgcttacctgcagagcaagtattcccgtcaggctgtacgttctcagattatctgtggcatagccaacacatattattcgctgctgatgctcgaccgtcaggtggaaatcactaccgaaacggctgccatctacaaagaaaacgtacgtgtaatggaagccatgaagatagccggtatgactaccgaagctggagttgcacagatgcgtgctgccagtcatcaggtagaggcttctctgctggacttgaaacgtcaggtacgtgaaaccgaaaattcacttgctgttctactggccaaggctccacagactatcgaccgcagcaccctcgatgaacaggtgatgccggaagaactgacagcaggagttccgatgcagttgctggaaaatcgtccggacgtgaagattgccgaaatgacgctggccagtgcttattatacaaccaatcaggcacgttccgcattctatccgggactgaatatcaccggtactgccggatggaccaacagtgcaggtgttgcggtattgaatccgggtaaattgattttgaatgcggttgcttcgttgactcagcctatcttcaacaacggaaagctggttgctaacctgaaggtatcgaaggcagaagaaaagattgcccagatgaattaccagcagaccattctggaagccggaaaagaagttagcgacgctttgttcctgtacgatacacagaacaagaagctgattgaagaccgcggtcaggtagaccagttggataaggcggtaacttataccaagtccttgttccagagcggtgacgctacttatctggaaatccttactgcacagcaaaatctgctgagcgcacagttgagcgaagtatccgataacttccagcgtattcaggctgtcatcaacctgtacagtgcactgggaggaggtagagaataattaaccttaaatatgaaagaaactatgattagtccattagcttacgttgacccctctgccaagatcggaaaaaacgttacggtacatccgtttgcctatatcgacaaaaatgtggagataggcgacgataatgtgattatgccttatgccagcctgatgagcggtacccgtatgggaaacggcaacacagtttatcagggtgcggtcattgcagccgttccccaggattttgcctatacgggcgaagatacgctggcttgcatcggcaataacaatgtgatccgtgaaaatgcggtcattatccgtggaacacatgccggacatgctacgtctataggcgatggtaacttcatcatgacaggtgtacgtttgtcgcatgatgtgacagtgggtaaccgctgtattataggaaacggctcacaggtatcaggaaactgtattatctacgactgtgccatccttacatccaacgtactgatgcagggaaacacccgtctgggaagctattctctggtacagggtggctgccgctttatcaaggatattcctccttatatcgttgcggctcacgaaccgattgctttctacagcatcaataccaaggtgctcgagatagcaggattctctgaaaccctgatcaagcacattgcccaggcataccgtatcctgtataaggcaaacacttcacagcacgatgccctgcttcgtatcaaggaacaggttccgccaagtgaagaaatcaatcgcattgtcgagtttgttgaaacatctaaattgggaatcattcattaacggtacttatggcaggcgtaaagaggaacaaatgcgatcgtgaagagctgagaaaacgggtgatagaagaagcgtcccgggcttttggcaaatatggaatcagaaacgtacacatggataatttggcatgtgccctttctatttccaagcgtactctttacgaattattctgcgacaaggaacagcttttgctggaagtcttgattatgcaccagcagaagatgggtacctatataagcgaggttgcttccagagctcagaatgctctggaagtaatctttgctttttacaagcgaaagctcaatgagctgaccgagctgaatccgcttttcctgcgcgacctgcgcaaataccccaacgtgttgtcttgcatacgcgaacgtcagaaacagagtgatgcggcggcattgattcattttcagaaaggcgtagaagaaggcatcttccgcgacgacatcaatttcgacatcatcaatcaggccatgtccatgcagtttgagatgcttgtgtactccgatattaccaataattatccattgtcggagatatacagcgaggtcactttcctgcacatgcggggaattacgactcccaagggaatgcagatggtagatgcttttttacagtctgtaaaagaaaagcgctgagaatacgcctcataatctttgaaaaaccgctatctttgcaactgttttgcaaagatttgtcgatgaaaaataaaataacattcacttttatctttaccctgctggttgtggcgggactgctggctttgtattatctgccgcctgtcaatttgaacggtactcctttgcgcaaagtcgatttgctgtccgacctgcgtcccgatccggttgtggaagaagtttccgattccgactctatccctttgccggttgtggtaaagcccgtatttgtagatacctgcaagaccggcatgacctgcattgaagattataccgattccctcggtctgggaatgggagcattttacgaagccctggagaacagagcctccctgggccgaccggtgcgtatcgcctatttcggcgattcctttatcgaaggcgatatcctgacagccgacctgcggtccttgcttcagcagaagtttggaggcaggggagtaggctatgtgtcggtaacttcccgtgtagctggattccgtccgacaataaaacataccttcgaaggttgggagagccatgccgtaaccgactcgtcaggcttcaagcgcgcttttcaggatatttccaatcattactttattcctcgtgcgggagcgtcggttactctaaagggcgggaaaaattatacagcttgtctggatacctgcgaaacgtcctccttctatttcttctcgcccgattccgttatcctgtctgcccagatcaatgggggcgaaagcaaggaatacatattccccggcgacagtacccgtatgcaagtggcacaggcagatgggcgcatcggtaccatccgctggcgtgtacagcaggcaggaaagcatacccgttgctttgcggctaccatggattcgcgcgaaggggtgattctcgataacttcagtacccgtggcagcagcggacagcagcttgccggcattccgatgtcggtgctgaaagcctacaaccgcttgcgtacctacgacctgattgtcctgcaatacggactgaatgttgcttcggaaaaagtgatgaactattcctattatacagtcgagatggaaaaagttatcgcccacctgaaggaagccttccccgaagccgccattctgatcgtcagtatcggcgaccgtgagagcaagaccgaaactggcgaactgcataccatgcccggtgtgaagaaccttatccgctaccagcaggcacttgccgccaagactcatgtagccttctggaatatgttcgaggccatgggaggcgagggcagtatggtcgaaatggttaacagcaagcccgccatggcaaactacgactatacccacatcaacttccggggcggcaagcacctggctaagattctgttcgatgccctgatgtacggcaaggaacaatacgagaaacgaaaggcatacgaaaattaacgtacgatgaaactgaaacaactagtcttttacatagcctgcctgacagcacttgtcgccatgcccggatatgcgcaggatgtccttcctgagtgtccgaaacccgacaagcattcttctccggtctatcccagccatgaaatacagcaactgatgcaattcgtgccggtagagagcaggatgcccgacacgttccggcagacacaggaaaacgaactgaccgaccctgcaggctccttacaccccttttgggagaaattaggacttctcgaccgtccgttgcgtatcgtgcacataggcgattcacacgtcaggggccatgtctttccttatgtcatgcgctgtagtctggaagacgatttcggctccaaagccgttgaaaacattcccgttacctaccagacatccggcatcgcccgtgaaaccggttccaacggagtggtataccacatattgggagtaaacggcgcaacctgccagagtttttccacgccggaacatatccgtcagatagccgacctgcatcccgacctcgtcatcttgtcgttcggaaccaacgaagcacacgggcggcgctacaacgcctccgagcataccgccgccatgaactatctgatagcggagctgaaagcctcctgtcccgatgtcgcctttctgatgactacccctccgggagcctatgtgcggaatggcaggagagggaagattatcaatccccgtaccccgctggtcgtagaaaacgaactgaagttcgcccgcgagcacggcattgccatctgggacatgtatgatattgtcggcggcaagcagcgtgcctgcctgaactggaatgcggccaacatgtaccagcgcgataaaatacactttacacacgaaggatatactttacaaggattattattatacgaagcatttataaaagcatacaatcattatgtggcaactcgattggactaaactggcagatattcttacatacgatccccgtcagccgatgattttcagcagcggactattcctgttcctctttctagggttcagtctggtatacgtacttttgcagaaacatactacggcacgtctgctgtttgtatccgccttttcctattatttctattacaagagcagcggcatttattttttcctgctgggaattgtcaccgtgagcgacttcctgctggctgcacggatggaccgtaccgaaaccctctggaagcgcaagctgctggtcgtgataagtttgtgtattaatctgggactgttgtgctatttcaaatacactaacttcttttacgaaatgctctgtccgctgtggaacggccattacgaagccttcgacatcttcctgccggtcggtatttccttctttaccttccagtcgctgagctataccctcgacgtataccgccgcgacctgaagccgctcgacaacctgctggactacgtcttttatgtatctttcttcccccagctggtagcaggacctattgtgcgtgcccgcgacttcattcctcagattcgccagcccctgttcgtttcgaaggaaatgttcggcgaaggagttttcttcatcgtaagtggtctgttcaagaaagctgtcatctctgactatatcagtatcaactttgtagaacgcattttcgacaatcccagcctgtattctggagtggaaaatctttttggtgtatacggctacgccttgcagatatactgcgacttctcaggttacagcgacatggccatcggtatcgccctgctgttgggcttccgtttccccatcaacttcaattccccctacaagtcggacagcgtgaccgatttctggcaccgctggcacatctccctgtccacctggctgcgcgattacctctacatttcgctgggcggcaaccggaaaggcaagatccgtacctacatcaacctgattctgaccatgctgttgggcggactctggcatggcgcttcgtggaatttcatcgtatggggcggactgcacggcgtagcacttgccgtacacaagttcttccgcagcctgcttcatcgtcccaaaacttaccgcagtaccggatggcgccgtgtgtttgctgtgattatcactttccatttcgtgtgcttctgctggatcttcttccgcaacaccgagtttgccggttcggtttccatgatccgtcagatcttcacctcgttccatcccgaactgttctcgcagctcgttgccgggtactggaaagtattcgccctgatggcagtcggctacctgcttcactggtgccccgatagctggcagaacgcttgcagccgcggcatgacacgcctgccgctggtcggtcaggcactcatcctgatagccctcatctttttggtcattcaggtaaagagcagtgacattcagccgtttatctatttccagttctaaaataaaagaaaaaatacccttttttgcccttcacgcccttcacatacggctcttccggcatgctcaatgcatcatcgaaacccgctgtgtgaagggcgtgaatagtaaataagcctattgaatgtctgtttatagcctaaaatccaccggaaacgtcccgatgttttgggaaaatttgtacaaaacattttattttttgtacaaattttcgagaactattggttgtattttgattgtggaaagagctgttcttttattattttttatcttatatttttttcaatgttatttgtattggaatgcccatacataatagatgattaccgacagaaaccatagaatcagtgcgatgattcgtaaagtagttgcccaggcatagttatcggacaagaaaccggcgactgcaaacagcataaaaaagagattggatgtacgcatgagtttggttaccagtatatattgcttgacaacattgtggctactgattcgtataggaaagttgatgtgtcggacagaggtataggctccgctaaacaataaggcaaataccagtatattgacgaggagtcccggtattgtatattcgggcagctcgtctgtatggtagtaattccaacagacaataccgatgccggaaagcagacagaaggccgccgcaatttccagtaacctgtctacggcagacggatgatagtgtatctcgggagcgttttttccggaaaatggtcctaaattgatggtaaacatattattcttcttttgtatctgttttcttggggttctttagcctgccgcttttgcgtaatgcttcgttgatgatccactggagttgaccgttggtactgcgaaattcgtcggcagcccatttctcgatggcttccattgtggcggcatctacacgcaagacgaaacttttggtggtattctctttttttgccattggcggtctttcttgattagtgattcaaggtacctgtattcaatactggctgggcggattcgtcggcacaaagcacaacgagtagattgctcaccatggcggcttttttgtcttcgtccagttcgactatttcttcctgggacagtttgtcgagtgccatgtgaaccatcgatacggctccttctacaattttctctctcgcactgataatggccgaggcttgctggcgccgtaacatgacggcggctatctcgggtgcatatgccagatagttgatgcgggcttccatcacttcgatacctgccatggccagtcgctcgttcagcttttgttccagttgttcattgatttcttctcctcccgaacggagtgtcagttcgttagtttcggtttcattgtcgtcgtaggcgtattgtccggctacctggcgcaaggctgcgtcgctctgtatttttacgaagttttcgaaggcgttcatgcggctggctaccgtactgcctgcgctgatgtctttgccattgctggaagtagaggtcgtacttgccatggtttgtgcatcaatttcgaacatggctttgtaggtgtctttcagtttccagaccagcacgagtccgataaggatgggattaccgattttatcgtttaccttgatgggttctacatctaagttacgagcacgcagggagagctttttcttgttcatgaaagggtttatccaaaagaaacctgtttccttgaaagtccctttgtatttgccgaaaaagaccattacgcgggcttcgttaggctccagttgcatatatccgccaaacaggataagccaaagaagaaaaagtactccgccaagtatatgaaacaattgtcctttttctataaaacacagcacaatagctgctgatatcagtaataaatgtacggctaacatgagaaatccgtttgccttaaatcccttgaaattgaattcttgtgcttccatagttttatatttaattgatattattttgatatcacaaatttatagaaaaagaatggattgggtataaaaaaagagaatgtttttcaacattctcttttgaaggattatattcgataaaatataatttgtttctgcgttaccagtctgtcttattttagtgaagttatggtatagctttcgtatagtacgccgaaggttccttcgctcaccagaaattccagtgggaaagtaaaggtcttgctggcttcgtcgtaggtagcgtcttcggcaagggaaacggttacagctccgtaggttgcgtcgttgataccggtggcaaaggaggaagattgcagggttaccttgtcgctgccatcccatgcaaatacgatgctacccgtacctgttccccagcatgctttcagacggtacatgtctaagatagctgagtattccatttcctgatcggtttctatcggatccagatccggactcatgaagtaatcgctgaatttgccgtcggcatagggcacgtagtcttccttgataacgttcagttccagacggggatagaggtcggactgtgtgtatgcttgggtatatgccggatcgatagtcagggtcatgggataggattcgaacatagccatgtcgctgcttacctttatggtaagggtcttgctgctttctccttgtgcaaagtctacctgtgcgggaacttcgaacagattggcgtaaacgcttgccatttttaagggaactgacagggctccgtcggtctggtttcgtcctacggtaatggtgaatgcggtatcatctgggcccaaagcaacttctgcgctgacgggggattcgaaatagacgttgatgccgttggcattgctggcttctcccggggtatattcgtcgtcgctacatccgcttaagagggcggatgcgagaagaattccggcgaggagggttttatttaatattttcatatttgtcttgttttagagttatacgattaatcggttacaccgtctttcagattcggattttgcaatgaagcgggctggcttccaccagcgttgttgacaatgcttgcattgttatttgattctttttgcggaatgcgcatgagcagatagggatcgtttgcttcgatgttaaagcaaaaggcatcgggccagttgcctttgtcggttccgtggaaacgaacaacaggcttgttcagacgcatgatgtctgccatggcaaagccttctccccacagttcaatacgacgctgtttccatatttcgttttgcagggcttctttggttgaggcggtgcaagtatagctcggatcgcggtatgtcttgacaaaattttcgagtttggtttttgcctgtccttcctgattgctcatggcaagtccctcggcttcgatgagtaacatttcttctactcgcatgatgcaccagtcgcagtcgttggtggcgcttccgataccgcttttcattccgaacttaacgttggtatagggtacgaatgccatttttacgtcggtaatggtatacgtcgctatgtcttgtccgctggcttctccccagatgagtccgtttagcaggtcggaatgcaggtctttgtctacccaccattgtttgcggatatctgtagctggaatttcatcgtatagtaatgtattgatgcgtttgtatacacctactgctgctgcatatgaggagccggagaaggaaccgaggtgtgacggccacgaggggttgccgccattctgggttacatcgtttgctgtgatgctgatgccccacatccagttgtggtcgtccatattgtagaaagcgggttttgatacttcctcacgactatagggggtatagcctttcatggcttcggctgcatcgctggcagcttctgcccacttgcccatatagaggttggcacgtgcgcggagtccgtaggctacttgcttgtctatacgtgtcttgtcacctttacggtcgtaattttccagtttgccgatagcatcgttcaggtcgttcaggatttgtgtatagacctgttctaccgttgcacgcggattgttgttgaaatctgtagtcgtttcggtgataagcggtacgcaaggttggtctttactgctctggtagttgaactggtagtagggggccagacacaaatagtcgaaagcacgtacggcttttgcctctccgatgtattgtttcaacttatcgtcttcggtattggggtcgatagaagaaagaatgtcgttggcaagtttcaactggttgtagaaataactgtagcgaagctgagggttggcatacgtttcgttacggtcggagtaatcgctcgatacactgaaccagttgtaactgttgttgtcgcagaccatatcggcaccgtttaaatcttgagagatgcaggcagtagggtaaccgaagtcgtcatctcgtccgctggtaggggcaccggcatactgggttcccatatagtggtacatacctacaaggctagattctacacgcgagggaatgagttcgttggtgctctcaatctgttcgctggtgacacggaatccttcgccgtttatgtcatccatgtcggagcagctattgagtgtggcacatcccat

SEQ ID NO: 7 - DNA, 67022 bp, Bacteroides coprocola
gaaaaacacgcttcttacattgtccggactgatacccgaaggaacagccacccatgccgaggatgacgaatccgtaccggcagccttcgacttgtaaccgccatgtcctctgatttcataccccctgacttcatttccctttccgtcagtatatgggaatccgatattgtagccttcaaattttccgttgttcctgtcccttataagggaaataaagggtgaaagagccgttacagtcgcttttgacagtccgcgccggaagaacagtccgggtattttttcggtatcaaccggcttcacctcatatctggaagcgtcaaacacaccgcatgattttcctaccgatttaacatactccctgtcctccctgtattcaggttcaggcatgttggcaaaacgtgccatgaccttggctatcttctgccactcatcttttccggataccgtaaaggaagaaagattctcacggatgagtgtcaccacatctcccttggaaccgtcacgccggaagaaggtctgtgccgccttgtcgttgggatggctgacaatcagcgtatcccttctgttgccgccttcaccgagcaccagttcgatgtaacgtccgataccggctttcctgtccagacggtatcccagggcatatgcaatgtcatcaatccccacacgggatttcatttccctgaaattaaccttgtagtcactcatgctttccgatttaagatgttatacagaatttcatataccaagtcctgtaccggcattccggttccggcccatcatggtaatctccggttcgtatgtcttccgtgccgtcatgttcaggaaagcctccttgtccttccagtccgtaagctggaagaatgtcctggccgtttccctggaaaccttcttcagccccagttccacaccatcgtatgacgcacggatggcatagtctccggaacgggtcttgacaatggccgcattcctgaaaggcatctcctcgtccgcactgacaggagccagcgggtcattctttgccagataaggctgttcgccgagagccagacgctgtttgtccacatggtcaagaatcaggtcggaagccttatttacgtcagccatgaccgatacgataaacttcggttcctgtttcagtacaccaatccacgagtccagataggcagcagagttgtccgttatcctggaatcaaatcccatggaatggctgatcatggcagccgtaagttccgccaccagctcctccttggcatatttcgggtcaccgaaccttccgcccatctccctgttcagacgctccggtgtcatggtggagtgagtcatttcatgcagcatagtagaataatactccattccgccacggtaggtttcttccggagaatcaccgatattgaactgcgccttcatgggcagcaccacaatatccttcgagggagaataataggcaccgttctcacgcttgtcggcacgtatcgggcatagccactgctgcgtctccaccatacggtcgagtgcggcatgggtgtacataccttccgtatccctaagttccggaaccttgaacctgtccataagcttctgcatcctctccggctgcacttcggccaagttggtctgtgccacattgtacaccgggaaagacttgatgaaaggaataacatccatattcttcttctcttccttactcattgtacggtattcctccgtgcttatcctcttgccgtgactgtcctttatcatcatatcccagtacaccaccgggaaagccttttcacccttcaggacatgagccttcaggttatgcgcctgcttgaaggtcagatataccggaagctggtagttcatggctgcagtatgcatctgaaggaagaaggaattggaaccggaatagttgcggccacccacattctgcggaagtccggcataacccgatgcaccgccaatccatccctgtttccatccggtatccttcatctgctgcatacgctcaatcatcattgcagcgaagcggtctatggccgcctgtccgctgtttccctgagagtcagttccagatgccatagctgtcgtcatccattacctgacggtccatctgctcgatgtccgtctgttccacatagaactcagccgattcatccgaagggtcagtaccgtgtgaacggcaccactccagataatcatctgcattcccactgtccataacaaagcggaggaaacctatcttgccctcctgcagaagctccacaagctcctcatgattcattttagctgacatataacttgtattttagttttctgattatgttacatttttatagaagccgatttctccacctttgcggtgttggcggcaagcataccggttatttccgtattcaggtacttggccgcaatctgttcccttgtggccgtcttggtcttgaaaagcgaatagccgtcatcgaaggagatttcatgccgggaagtctgtcccttttctccgaggtcaaccgacaccttccatttgttgtcgttcctgtccttggccacacgcacacccttggggtcaacaccttcaggaagctgatacttctcgtatgcggatttcagatgcagacgttccccgaagttcttctcaataagctggtttggagtggccaccctgtcgaagtaggcattcaggtcctggcgtgaagccacggcagacatgttcgtatccccaacctgaacatagaacttgtatttcccaaagtcaggacgctgctcgtccttctccttatagacattgaacttgttaacggttatggaaccgtccggtcctgcaatctccattggcatacggaaggcttcctcagaaaccttcggcatcagctttgtcggatagtagcgttccatcagctgcggtaccgtcatttccttgttctgataggctgcaaggtctgctgcatccatcttctgcggcttgagctgctgtccgtcaatctttgcggtaaagtaccattcggcaggattggtgttactctggtaggcatggccgtgagtaaccttctcaccattggcagtcaccatctgaggctcacgtggcttgcgttcctgtgctgtttccgctttctgctcttccttattttcggcctttacctgagtatcagcctttacttcatctttagtaccggcatcacccctggagtccttttcccttgcaggttttacgtcaacagtgttctccactgtcctgtcaggagcttcctgcacaccctgtttctgttcctttttcttctttcccatatctgtactgttttgaatggttctgtcattgttctcagccttgtcctgtccggccttcttcttcaaggtactgtccagaaaatcgcatattgctaccctcacgcctgaacgtataagcctgggcagataagtgtccaaagccgattgggggaatgatgtgacctttaccggccgtttgtagtcaggcagaatcctgtctgcaatattgattccaagcagtactgcagcctttacggcatcctgcctgtacagttcatagaaactgttccgtctgaacagcagcagtgcatccggatgcttcttcttcagttcgttgaactgccggattataccggtaccattttctgaatctttctttctggccatatgaatcagttttagagtttaaggctgtttgcttttgtttccttccgggatggagagagtgaaatggcacgctcaacggattgcttgtccaccaccttctggtattcccatcggttcctgtcagtcatgacaaggccgagatattcaggatgaagttcgtcatagcggattttctgctgcctttcccattccttcatgtcgcccttgataagcttgaatccctgttgctccttcaggtcaatgccgaccgaaaccttctcaccgcccacattcagctcaacaggttttccctcacgtatctgctgcttctgctgcatacccagttcgatatcgttcaccttctccatatccttcagacgctgctccagctttatgtctgttacacgtctgtggatgacggatttcgtctccggatcaagctggagatactgctgagtcttttcaccgtttacgttgaccgccttctgtattacctcacctttggccaaacgttcagcctcctggtgagtcagattgagaatcttgttgcgttccctgtccagctccgcacgtaccggataggcaatcaatgctggagcaccgtttctgtctgtagtcaactggagtttcatcggcatggtgatgacactgccgttccttgcgttgatggatacctgcatgatgggagtcacttcacctgccatcagcttctccttcacttccatgggtaagttgtccgccttttcacggtctatacccagtattgccagtttctcatatggcaacaaatcggactgatttctgttgtgcatttccatattactgtaattaagctgttatatttgcggttataaccacctgaataccacaaatgtattcatggtaattccctgaaaaagaaatgcgcaacactattctgatttctctgctactgatgattctgccggtaagcgtatcggcacagttctatacgataaccagggaatcggaacttctgccagcagtaagacaaaaagaggcctataactatgctggaaaggatgttacagaagggaaaaagaataagataatggcaaaggataccctgactgtcagatcaaacaatcataatgaatcagaagaaaacagccggaatagtgacaggaaagcatccctgaaaacagaacagcaaaagaaaacagatgacactataaaagcagaaaatcatcttcctgaacttaccatcccaaacctttataaagaaatcataagaaacggaatcctgtaccccaaaattgtattggctcaggccattctagagacaggatggtttcgttcatcagtatgcttaaacaaacacaatcttttcggactaaccaatccacgtacagggaaatactatgaattcaatcattggacggaaagtgtcagagcctattacactaaagtgcaatataagtacaaaggtggaaactatttgctttggcttgataagattgggtatgcagaagatccgaattatataatggcgattataagtatattggatatgtcattataataattgtcccttaaatatattattatcataaaaaatcagtatattatacttattgttcaacttaaatttcaatagtcaaacatttctttgagttcatatcttaaaatcgttatatttgcgttcaaaacagataaatatagttttatggaagatttaaatagattaaaactagttttggttgagaagaaaaaaacgaacaagtggctttctgaagaattaggtgttaatacaacaactgtttctaagtggtgtacaaatacatctcagccggatttgtatacacttaaaaagatttctttgaaattaggtgtaaatattaaggatttattatgcgatactttataaaaatattattaaagcactaaaaagcatatggcaaattttataacatgttatgataaagatttacaagatttggcagattttttaaaaatacttgtatcagcaaatgactcaattaataatcttgattttagtttagtccaatttaagaatcaagatattgtatctaaagaatatgttctatacttaggagaaaaaagtgttcataggaaatcacaaatgtttaatgatatttacaataaatatggtattcatataggatattatgggaaaaatgcatggctgtattgtgaggactttgattggacggaaaaatcatatttaaattttaaaatagaccttataactattttaagagatttaaatttagattatagaaaaatagatgctaatatagaaaagggcgtagaatttttatctgctgatttgaatgatccaggttgtaaggttctttgggaaaccgctgttaatgattgtagaaaatttgaagaagaggatgataaatcacgtgttattatcccatttctgaaatttgatgaagttgaatgttttcaaaattgtatatctgaattcatcgatcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtatgataccaaaaaaacttatctaattgtatttttttcccttttgtttgggagggtgtttagtaatttatatatttgcgtttgtagaaattaatagcaagatgtgtttttgtgtccacaaaaaccaaatcttgcctgataaatcaggagtttagccccctcgcaacttgggggcatatattatttagtatcatagtatgaaagcaaataaaagagatagaatagtgaaagttcgcttaacgaatttagaatatgaagaactaactaaagcttctaaatctagcaaatgtatgtcagattattttagacagagagtctttaggaaaggagttggtcttattgaccctaaagaatttattcgttcgatggatgaaatttgtttggaaatgaaacgtataggaaataatataaatcagttggctaggtatgtaaatattcataaggaagaagttaatcaagaggttcttaatgaggtagaaaagaaaatggcagactatgtaattatgcaagataaattgaatgttacttggcgtaagttgatgtcaatcaaataatatatgtatatataatattgatatatataattttagtgataaagacagcgttactatttcttttccctaaagttctttgtgtcgtttctctctatacttgaatacaggaaaacggctgcatcataaaagaaaagacaccgacaccattcaagaactaccgcccatcggcaaaaggattgcatctaattgataccttttctgcctgcactggagagaaaccgggaaggtatttgataccgtacttttccgggttctgcccggcatggacgataagagaacattattatgataccaaaaaactttagggaaaaatattatatatataaataatatatgaatatataatatttgtatatttattatatgaataaattatattgaaatattcttttattgaatatttgtttgtatatttgcggtgtgaagttataaatatggtagtagtagttttaaaagcggcaacttctttcgctggtattgattataatgagcgaaagaatgaggaaggcaagagtgaacttcttgttgcagaaaattttgctatgaatccagataatttgaagaagtcggattatatagcttatatggaatctgtctgtaggactaatccagcggtcaaggcaaaacaatttcatgcagtgatttcatgtaaggggcgtgaatattcggcagaggatttgaaaaatgtagctttgcaatatataaataaaatgggttatggaaataatccttatatgatatattttcattctgatacagaaaataatcatgtacatattgtttctacacgagtacagaagaacggacagaaggtaaaagataatatggaagctgtgcgctcacagaaagtcataaatcaaataatgaatgttgatttagctttgaaggctaaagatgacatttcaaaatacatggagttttctttttctacagtgcagcaatataagttgttacttgaacaatcaggatggaaattaagagaaaaggatggattattaattttgtataagggtggtgaaaagcacgcttcaattcaattagagcagataaaagataaagctaaacaatatacacctgatgaagaaagaagaaaacagataacagctcttttatttaaatataagcaaggactttcctatacagaacttcaaactttgatgaaagataagtttggtataaatttagtctttcatacaggaaaaggacatactaaaccttatggatatacattaattgattatagaaataagagagttttgaaaggtggggaagttatggatttgaaggaacttttagtagagcctaataaacaagcaaaagttgaacactgtaatagtataattaatcttcttttgaaagatggaacaaaatatacaatggatagtttcaagaaattaatgttagattacggttataggttttcaatgaatggcataatatttataaatggtgatgataaggctttattggttcttgataaaaaactgttgaaagaacttagatataatagcagagtgtatgaagcaaataaatttaatgttgctacacttaaagaagccgagttgttaagtagaatttatcatgtgaaaaaagatgatattttgattcaagagcatatggataaaaaaaatactgtctattctgatatgataaatagttatttggctcatagttcagatttacattctacattaagagaaaaaggaattctttttgttgaagatgataatttagtttatctaatagataaaaagaataaagtaatcgtaagtactgatgatttaggaatcaatattataaaagatggctatagtaaagataggattactctagttactcttgataagatggaaagaataaatgttgaacaagattcagaactggcaaggggatttaatctgattgatgctatttgtgatattcttagccagcatataaatgtacagcaagataaatctcctaataggaaaaagaaaagaggacagcaacaaaattaataaatataataagatatgataatattatttgggaatcagaaaggcggttgtggtaaaacgactaattgcatacaatttgccaactatctagtagaaaaaggaaaagaagttctagtattggatttagattttcagcgttcattatcggatagaagaaaagaagatattgcgacctatgataatgaacctaaatatgaggttatacaaaccgatatatctaatgttgctaaaattattagtgattttactaaggttgagcaaggaaatctattaatagatttgcctggtaagattgatgatgatgctctgggaactattcttaaagctgcggatataataatatgcccatttaaatacgataaatttacaatggatagtacaggtttttttatccaagtgttacagtatttaaatgtaaaagccaaaatattctttttacctaacaatatgagaactgcggtaagatatgaaacaaaagaacaggtagttgatattcttaagcaagttggttttgttacagatgaaataccagcttctgttgctatggaacgtataaatacattagcaattagtaatgagtgtattgataaggtgaagaatgcttatgattatatcattcaagaaggagcaataaaataaaatattcttttaatagatatttgttataaagttattcatttattgtatatatttgcacatggctgataaattaaggaaaaagcaaaatgaaggtatttctagtgttctggaaatagctaaaatgataagaggtgaagaattgcatgggagtagtataaatgaagctcctattcaagaagctaaatatgaagttgaagaggagaaagaaccacttcatgtagaaatggaaacaacttcttcggaagtttttaattttaatggctctagtgaaatggatttgacggacttattagagtacattaaaggaaaaaattataattgcaaggaagttctatatgttgatacagatgtaaaagaggtgtttgggttgctcaaagctaaagccaaaatacctatttcatctttagtttcgtttattttggaagattggttaactaaacaccgtagcgacataagttctttgattaagcaaaaaaagaaccgttttctttagtacagaaaaagggtcgttttgtgaaacaaaagattttggttaggctagtttagaaaacacttttcttttttggttttatggtatcaattctttgcgtccggcttccggcagctttttgtatttggtatcaaaaggttgttctgcagggtgtgccaggaatgataattcggtatcatttcatcatgccatgtttgcccatcagtgccggaactccgaaaagtacggtatcacaaattctttaaagtaatattgaaaataaaagagagtattttgtactctcttttattttattaaggctgtaataaattgatggctttttgaagattagcttctagctcttttttagcgtttgacatagcatcctcatagtttttttctgattgtcttataatttctattataacagaattataattggctttttgtgcttcatcttcttctgtattagaaatcagataaaacttttcactaaatattaaatctataaaaacatagttagaataaaaattcagcacttgaaataaaagttttaggctgcccccttttcctagttcaagatttgaaatcgcattttgtttacagtttagctgttctgctaattgagcttgggaatatcctatatgctctcggatttgctttaaccttgtgcctaaaattggtaatgtaatgttatacatattgttctattactgtttctacttcgtcgtatattctcttaaagtttttttgcagtaatttctctctattatctgctgtcccaaagttatatacttttggcagttctttgtaggcttcttcttctttcttaattttttttaaatctaaattggttttgcaatggtacatcgctgttggaaaattatcttcttgtccaaaatctaatgcaacttgccctactaatgtaccagcttgtaatgaagatattttggatgccgggataacaaaatccatttgttcattcatattaattgttgtttcgtttcttctgatagtaacgccttcttttacttgcttaacttttccaaatagtttttgtagccaatctaaagtttcaggagctttagcttgcccggataaagtgttacctataatagaagttatagtttttgcggtagctttgccgtattgttcttctaattgcggtagttcctgtaatcccaaacaaattgaaaccttattgctacgtgcagtagaaagtagtgttgcaagttgataaaaatataatgtgggacattcatctactatgattgaagtagggtagttaccttttgtattgacaagtctagttaatcggttaatgataagtgcatttaaagcactattcatgctttgtgttttagggttatttgcaatgataagataactagggtcttttttatctgatacttttaaattgaaatcattgccactaaatacccaaaaagattctttagttgctagtcttgataactgtacttttagacttgccatctgtccttctaattggtccactgctcctgatttatatgcagcttcaaatggggaaactagtgattttaattcaggttcggaaaagaggactttaaaaagtacgtcatattcttgattaaggaaagccagtacatgcggtaaatctgaatatttgccattctcgtatctagaccaaaaataaatagaagctgctaacaagtttactgctgatgttttaaaaaaatcgctattacctccacttcctttgtcgcctttttgtaaactctcatataatgcttctgccgtttctgttgcatctgctaggatttctatatattctcgtttcaatgggtttattcttctactatattcaatatcagaaaaattaatgacattgaacttgaaattacttggtatttttcctaattgtttgttcttttgataattataatatgcaattttggcaagttcaggaaatttgaagtcgtaaacaacttctgcaaatcctttagctgaatgttgtcttataaaagaatttataacagaaaaagatttaccacttccaggcgttcctattacgaaagttccacgaaaacagttgcatatattcagccacccattatgccactttctattgtagaaaaacttcatcggaatattgacagagaattctgtttctaccttgtctttagattgttcaaagctttcattctctatattaaatctatctttcataaagtttgatttaatacgtttggaaatgttatctagagctgaatttattaatgtcgctccaattattgatagtataatgtaagctatattataccattctaaactagtttctcctttttctttaaagaaaagaaagcatatacttccaaagaacattatgaatccgaagattaaaggaaaaatgatttgtttagtcgggtctaattctaaatccttttttgaacgtgttccaatgcaagtaaccattataataaagaatgtaaatagtttactataaagaatattagaatagataggaatttttgccatttttgataataagggcataatttgttcactaaagggaaaatgaacaaatagtagaatctctatgcaaacagttatataaatgaatgcttgcatgaatccatatagtttttgtaattctttgctttcttccatgatttaatcgggtattttaactttttcaggttcctcacattgaaaagccttgaaatcttctatagctaatttcaagtcttctaaaaaattgctattgcaacctttttctactgctatctggtaatatgcttccattgcttggacggaacaaatatctgttccgcatattacaaaagctggaatgtcttctaataggcacttgtgtaataatcttttttggtctttcattttattaattcaaatgaaaataccactcttttatgcagtgagagtggtattggtttttattttttggtatcataataatgttctcttatcgtccatgccgggcagaacccggaaaagtacggtatcaaataccttctcggtttctctccagtgcaggcagaaaaggtatcaattctactggtaattttcttgtccgaatatatgttgaaccattgcataattttcaccactgttagacttatgcagcttatcatcaataaaaatttttacttcgactgtcttaggtagctgtaaattttcaaggttttcttcatctttaggtatagggtaggcagatagccataaatatgttccttgtttggcttcttgctcaaatgtgaatggactttctacaataatttctttggcagcttcttcgggagcttcggaagaaatatctactcctactgtataatgtattagaagtttgaaattttctgggtcgcttacggtagcttcataacgtacttttcctgtatctcctgtaggtggagtattagggtcgttgttatcgtctttattgcatccagacaacataaggcttaaaccaatcattactaatgataaatactttttcatattgtttcttttaaatagttgataattcaatgtgtatcgttccatttgcagcattatatgctacttcctcaatattggtgaaccgtcttattgattctttccattcttctgtttgtggattgtggtaatattcttcttctaatagacttatcaaattatttatttgtttgtcagatagataaatcttttctccaacccttggaactacaggtaattggattggtatagaaatattgttcacaccatctataggaatatggatgtttatttctatcatagccatttcatgtttagtatatttttggacggcttaaatttaacaacttccttttctggaacttctacaggttctccagttgccggatttctagctatccgagctggctgaataatctttttgaaagtaccaaaatcttttatagaaacatctttttctcttagattttgagataattctttgaaaaaactatcaattatttctgctacttcttttgttggtttatttgccttttcagcaaccattttgattaaatcagtcttattcatttgcatatcaataatatttaattacttaaatcacttaaacaaatttcaggaataatttgggtatagtcttctgtatctggtctataatgtattgattcaactatattgacctcacagataacatcatatacccatgctttaaaatttccttctaaatcatcctcaccatcattgaatttattaaaatcacttttagcttcatctgttagatattctaataaattttgataggtaaattcattctgaaacattataatgtgaggtgaaatttcttcgcctatccttggaagatgcggaaaattccaatcaccctttaccttcattcctctctctttaaaaaaatggctataaattataaattctattttcatattagttttattttaaaatcatcgttcagtacaagctttctttccatcggttgcccgtttttatcatgaaatccagttaacacaggtgtttcttttttctcgcaaagttctattgcttcttcgggagttatagaacgtcctgacatttcacgccaaatgacaaaatcacattttaatctgacatttctatagttggaacaattataggcttttttgtttatatataagtttcctccacacttaggacacttacacaatgtattgtcaaaagaaatatctaagttctctgttagaaccagccgtgaagaaaaatcatttccttctcttgatttaaatccagtcataaacggtgttttttttcctctggcaagtatttctgctgcttccaatggtatttctctttgtgcaatagttttgggtatatagaggttacaaactctgttgttgtccttgtccttttgtgaataccctttacaagcatatccatttagtaaaatttcaatttctctaccacacacaggacacggagtttctaatacttcatttacgaaagaaggaataacgattccattttcgatagtcagatatgcagaaaaaggaactccttttttattatggaagtcatgaaatatatctgttttccctgttgttattaattgcctggctatttcttctgtaatctcttttccccaatatgaatgataaatattaaatgtacatttgtcattcatgtttttgaagtaattacaggaatatcctaaactgcctttcattatgtgtcctttctggcaaatagggcataagcctaaatctttgattgtatcattatccatttaatatcctcctttactaatccatttaataccgtttaaaatattatctactttttgtttcccactatttacatatttaaattgtccgggtacaagtgtttttagtactccagcccttttagcggatttcatttgtcggcatacagcgtatgcaagtcctcgcattcgtctaagttcattgaccacatgaatacataaatctatcctttgcttattatccataagatttttttcaccgccttgcaatgctatattgtttatgtatatcattaaatctacacttcgactgataagctcatactctgtttttgcaattatggttaataatttagggtctccaactgcatatttagctgcttcggattggtatttagctatgtctctagctaaggttgaagcataaataatatcttttccatttttcacaactgcattaactgtagaaagatagttgtatgtcttctcctgtaaggattgaatttgattcattttttgttggattaaaatttgaaagttgcggatttttgtttcctcactttgtatgtctttcaatacaccttgttgctcctgatgggaataaaccaatgttccaatcattaccgggtcaatgacaatagattgtgctagtccttttatgttgcctaacagtaacattagggaaaaaaataaaagcactcttttcatatcattatctgtttgtaaattcatatattccttttttctttttttgttcttctactctatttctgatggtttgaattatatcactattagctttaagaccattcatcagtagttctggtgttgatttatcgccagaataaatgtagatattggtgttgtttattaaagactggataaaactttgcttttcttcataatcatatacccgatataattctatgtagttaatcctttttgaaagcactccttgatatatttttatttgctctctagttataatccattttgtacaaagtaacattgaaatatatctgtagaaaattataaatatcaacaatactaatatcgttccactgataaattttaataattcatgttctcttatatatttactaaaaatgaatacgaaaatcgctaatgtgattaaaaggaaattcttcattaaccaatatcggaatttaggctttaatataatatcatcagaagctatgtttgttccatcattcataacttaatactttttttttgttcatgttgtttcattagaatttcattgaaatcttttgctttttctgctttatgagaaatcataggagctattattttgcttttttccctaaaactttctagtgaaacgtcatttttgttaatagtgaattctctacccttagttttaaacagcacatcatctttattttcttttattgtcatttctgtattactaatgattccagacactttaatgtcatacaaattaccgtttaaatcattatcaaaacaggtatgtactttagcttgtgggtatcgcaataaagtgttttttatttgattaactgaaatgtaccctcctacactacaaaaaacactttcttctaatttgattttgttagcattgagctgatagaagctcatagcatctaaagcggattctgcaaagtatatatgttttgccatttgggggtgtgggcaaaaatcagcaatccaaagcgagttacttttatcacctccggcagccattcctttgaatccatagtttcttaattcgtaatttgttactttgttgtctttatcttttggattaatatagggaaaacctatattataataattgccgtttccttgtaagtctttaacccttgtgataaatggtagaaacttttctacgacttgatgatttatatttctttcatttgtgagaaatcttaaatcagcgagtgtagtaggaaattctttatatctatctctgtcaaaagatttgttttctgcttttacaactttgaatgcttcatatttaggactataaggctcatttgcgtaatgtcctaaaatcatattgattcgcacaaatgtattttgatgttggaattgtgggaagtcgttaatatgatttttgatgaactgaattaaatctccacctttataattcctatcatagtagtgttcttgtacactatgaggattcttgatgatgatttcatccaacttgttacctgctccgtctgtcagtttaaaaacaggcgaaacctttcctttgctaatgtcttgtttatatcctaaatcttcaagtatttgaatgatggatattttagccttataatcgtcaaatgttagcataatattatagtttcattgttggagtatcattattttttccgtaggttctaccatatccgagaatagatgcttcttgcttcgctgttgctttaatagaactatctattttatccatttgggtagatatttgttctccgacagtttgtttagtagcttccctagagctggaatatgttttttctacttccttgtaagaagcataatctttagaaagtttatgtttctctaaaaaggcagccatttcggtgggtttatctttaaaaatttcatcaatccctttagctcctttttgggctacaaactctaatctttctttatcagatatatatctttctttccctattgtttgttctttcttttcagtcgctttaatttctatagtatttgcatctttgattgataatccatttctggcattcaaatctagttttacttttgcagctttgtttagttcctcgtttacaatggtaatttcttttccatttttgagattttcttgctgcataggagtaagctctattcctccaagtttttggggaatatgaatgtcttttgcttttattgatactatctcattagtatctttgtcacgttggtgcaatgttctttctccttttgaattagtctttactacgacattatcagcttttagggcttttatttcatccttagtaaaggataaatcattttttatttcttgtcgtttaggaatgagcaagatagcaatcccagcgattgggtaaactactgtaatagctgcgattgctagttttctagcattgataccatcaattttgatgcgtttaccttcttctttgaaatcaatttcgttggtttttaatttagatttattttcaggtgtattctcggctgttatatatttaagagttgttgctttcccctcaaaatggagttttccattttctgttttataagacactttttcattgtctagaagtgttctattaccgggagtatcttcaatggaaaaatttagcatacctgtttttttcccatttttgatgtttgcaatatcttcggggcttaaattttccggtttaactcctacttcattaaacttgttccagtctatatcaacatatgaacctttaccatctagggtttggttttgttcataagcatatcgataaaggtcttctcctttatatgcaattttattttcaaggtcaatgactgtaaatccgtctttatatccttcattcttgttagtaccttgttttatatcatcccattttataattgcaacattgtggttttctcgtaaatattggctatattcttggaaattattgctagcttgttctttatcaaagaaactgattattctttctttagattgctctaataaagattctctattatctcctaaattgccaagtttaagtgtattcagtggataagtatatgtttcattacctttggaaaaggtaatatcaccattccgatattcttctgaatatccaagaattgctgctattgctcggaattgtccggcattttcataactatattgcaaagcttcaaattttttcttttcttccattttataatttgaatttatgttctactttagattgcgattcatttccaagtgttgttttttgtcctttcatgtattctatatattcatttctgtttttatcagtatgaatagttcctataatttgtgggttatgccggtcataagctattttctgtttctgctcgaagtctaggaattttattcctcttggattatttaaatctaatcttatggcaattttttctttgtcaacattcaaaattaattccttacctgattttagagtttccttttgttgcttatccagctcaacaccttttatgtttgaaggtattgaaatacttttgatttttgttttaagcaattcgtttgtttcagggtctaattgtacgagatatttttcattgttaatagtttttgttattatctcgttatcttgaagtcgttctaactcctttggtttaaggtttatatcattcattatttctggtctgactggatgaactttaacgccagcattgttgctatctttccagtacaaacttatttttcctttcatacttatttcttctccattattatcgtgaaaagaaaggtctagtaaactggttctctttccagataatagagctgtgatatttgccttatccaaagaccatatctgtttttttgatattcctattagttctaattctttatatggaatatcattttcattaaaaatagcttgctttttatccatgtaatgtatatttttgcccaaaagtaataaaaatatcaatatgaagaataaatttatcatgttttttacttattcattgtttttttcagtgaatggctactgtcagtttaatacggtattacagaaaaaggatattcctaaagcggaacctgtattagcaacgacagaaaataaattgatagaagaaaaagaaaaggctgttgtcgtcaatgatgctttgactacagaacgacttgcatactggaagcaaagaaggtatttatctttgcccattgattcaatggtgataacttcccattatggtaaaagaaaagacccatttactggaaaaatagcaaatcatagagggatagaccttaaaggcaacaacgactatgtttattcgataatgccgggaatggttgtaaaaacaggaaaaaataaagggttgggcaattatgtagaagtgcgtcatggtgattttacttctatctatgggcatttatacagtgtgcttgtaaatgcgaaacaagctgttgaagctgggcaaccaataggcattagtggaagtaccgggcgcagcacaggagaacacttacattttcaaatggaatacaaagataaaactatagaccctaagccaattcttgattatattaatgaggtaatcagaaccgttaaaggacaaatttcacagcaaatagataatgagttaagacgcaaataaatagaaaaagaggattggaaaagccagtcctctctttttggaagaatcagaagaaacctttttttaatcctttttcttgtctttgaactttttctagtgaagattgaagttgtaacagagcttctttcattcctttttttacttcaggattcgttacggattcaataagctcttttcctctttgaatgttagtgttaagtatttctttattcttcatctgttttgaacgactttcatctataaaaatagatggcatacttttgcaactccattcaccatttactagattgaaatctttaattctttctttcgctaagtaggtgtggatagaaatcttatctacagccttatcactgtataattgatttgcagatttcattagtccatttacggctttgttatgtgaatcaatatcggctaatcgtccttgtcctttacttagtacttcttcttgatacctgttgtaaagtcctagttgggtaaactccttgggggctgcaataatatatgcttcaactctaaatcctgcatctttaaatttttgtgctgtctttaaaggcacatctggatttctcatagttccttctataataatattgcatttccgtttaatggcttcttctattagtttttctgtaaaaacgctagaaaaaatctgggtttcaatggggtatttaatagggtcttttattagttccttattggggtgaaactgtctgtaaaggtcaccattaacagtgagaaaatctaagttaggatggtctttctttgcaacatttataagagtgctttttccgcaagctggttgtccacctaagattatagcaataggcttttgtgatgatatattgatgtcctcaaataagccatcttttttttgttcaaagatggcttctacttcatagcgttgcataatatgctttcaatttaggtgcgtaatagttttgtatcttatccatgactgataagcgcacattttcagaaacttcaaactgcaacaatccatttgctattttttcttctgtgttgagaacagaaagttctttttgcagtattttttttctgttttcatccttctcttctgatatttcatctatcttcatcatgcggagtgtcccgataatgtcgagcgcaacatccaagctcatttctttattcatggttcattatagttttatgatttatacttcaatagattctgtgaattttaataatggaataactttcactgtatgaaatgaaagttggttaaaaagcttatgggtctttagcatttcaatcgctgcatcagccgtaacaacaccttgttcataaagccggattgttgcatataactggtcattggcaacgggtcccattattaaatcatagctgttttttccttttcctctgcggttattaactacaaactccagccactcttttgtagccccatcaaatcgaaggactgaaaactctctatcaagaatattatcggggacttcataaactgaaacgaccgcttttttaccatgttcccgatttcttttgagtattgcccacttcttagcctgttcaaaattagttgtcgtatagaatccttttccaaagtcagtagctttacgccctttctgtatattaggggatttgacggtaactgttgagccgtgatatagtttcatgcctttttattgatataagttattatagtatctaatatatactctgtatcttgtgtgtgcagcatttcaaaattttcatatagaaattcaaaaacgccatgattggaaaacagcaaaagagtttctttagcacttatatttttagtttccctgtaattttcagcacaaaacatttgaaaaagcaatatctttggattgtccttttgtactttcttctgttctgttttctctttttctaatgcttcataaagtgataatgtacttgaataccatagttttgtattctcgtccaataatgccttgtacaaattggaagaatatatatagtataacgcatcttctaaaggtagcgtttttcttttcatgactgtatcaaccaattctctcataacaaatgggagcatagctgaaccaagttcattttgatatgtttgattagtttccataactatttattttctaattttatatagctatcttgctgatgtctttagcaaagatagagaaaaaacaatcatcatagacctattgtattgattagtttgtaaataggttctttgtatttctttagatttttaatttgtataacatacttattgattcctaactcattaaagatttctgcgtacatttttattatggattttctgtagtagatggttaatcctactattgcaatgcaaataaaaatcaaatagactagttcactatacgcatagattgctaatacaaaaattccacccatagcccataaaaagctacttaaaagaaatcttaagatattcataattttgtttgctgttctttatactggcagccaaaccagctttaaaggtttgtttatctctttattttcaatactcaaagatagtggttttctataaatgtcgcaaataataggacaattatttttgttaaaaatagttttaggtttatagactgccgaagttttatttttccctaaagtttttggtatcataataatgttctcttatcgtccatgccgggcagaacccggaaaagtacggtatcaaataccttcccggtttctctccagtgcaggcagaaaaggtatcaattagatgcaatccttttgctgatgggcgatagttcctgaatggtgtcggtatcgtttcttttatgatgcagccgtttttctgtattcagatatagagagaaacgacacaaagaactttagggaaaagaagattcttcgtgttgctctttctggaagtggagtatattaatcatatattatatgtttataggttcatatattatatattcatatattatttatatatagtgttttctctttgttctttttccctaatgttttatggtatcaattttttgtgtccggcttccggcagctttttgtatttggtatcaaaaaggcgttcttcagaatatatcgagcatgataattcggtatcatttcatcatgccatgtttgcccatcagtgccggaactccgaaaagtacggtatcaatttctttccagactataaaacaaagaccgagagttttacctcccggtctttgttaatagaaatctctctttttaatattcatcatttgtgataaatatttctactctcctatttttagcacgtccagcttcacttgtattgtctgcaatgggttcgctatatccttttccatcttctgttatgttgtttgtttctataccagcggttctaaggtaatttcctactgctgctgctctatttttagaaagtatgatattgtattgtttttctcctatattgtcagtatgcccaattattttaatcttagtattgggtatttcagtaatgatattacataagtcagaaagcattttttgagcttcttcatttaattcatatgaatcaaatttgaataggatttcactttgagctgttgctttaaactgttcttttccatttttatctttatagctggagattgataagccatcaatagcttttagtttatttcttctagcttctatcttttcttggatagctttatctctttcttctttaactaattttgcacttccaccaactattgaagcggttgaatagttactattattttctatcatgtctttttctttgtcgcttagttcagcgttactgaaagttatcatatgcgttgaagtacatgcggtaaaaaatgtaacaacgaaggctgctagtataattattttctttttcatgattatcttattgctataataggtctgattttaaatgaatttcttttgcttgtactggttgctcttccttttgttaatgaagaaattagtgcaaacactttaggagtatcttttcctgctccatcttctgtagaactccagtaccaaccatcaaagtgcgttcctccaatgattgagaaagaagaatataccttttcaagattattagagattgctttgttttgtgcgatagagccaataaaccaacctgtaacaccttttggtgcgtattctatagctttttgagctgctggataagctaaactatcttttatagcaaagttcattattgcggcagtattagctgctccatcaaagctgttttcatcttccgaagcattagctatatcctcgtctgtatctattaaaggattttcttctaaatcttctaatgaaacggcataagcggtttcttttatatcaggattattcccatcattacaccaaaatacaactccaatggcttctttttcattgggtgaaaaaagtgagggatgcactatacttccatcactacataagatactacccggctgtaatgatgtgtctataatatcttcgtgttttgtacatgatgatattacccctataatggataatagaattatatatatttttttcatacttaattatttattggaaatttgacacctactaataatccatttcggaaatggtcacgtgtccaaaagacaaaatcatttttttgcattacaaagacttgcattccatttctaaatgaatagctatattctaaacctatatcaatggaagcctgaaacccttttctgttagctcctaaatctgctccaaaccgccatcttaaattactgtttttgcctcgtgagattgtaggtttatatgctgcacctatgccgaatgttttatagctccagaaactatcagagcataccttattacataccgggcatttatcatatgctgtagctaaatcaatatatagttcataagcattgtgatatttaccttcaaactccagccctacaactgcattgacggtatttttccattgccaacctcctgaaatattaaaaaacttatcaccatcaccagccattgactttagggaaaaaaataaggtgataacaagaaatgctattcttttcataatcgtaaaattttattcagtaaaagcatctgcatgaagaatgtctgcataatcaattcttaatgttatagtacgtcctgaaatctgtttttcagatatttctatggtaagaactttttcgtctgggaaagtaaatttttcaaagacaaaaatatttcgatagttcttcttgaaaacaagattcttattaacttgcatcaatggaagtatttctatagattgaaaattagtagcctttgtttgttttttatcttctattttgaagcgtatttggtctatatcatatcgtatttttgttttattaatcatagaaatatcaataaagaaatacttatctaatgtgtagatattgtttagtacaattttcattaggttacttttactggaaacatcatagaatttattttttgaaataaacattctatgtgcgtaatcatacatttgtgctttggttaagttcacttctggattcatatagctacgtaaatcagcataagggatattaaagcgagtgtatgcttttgctaaatcgctactatatactagcatatattgtacgaaaaatctttctgtaacaatggtgataactccactagctccttcttttgtgggctttattctaagagagttaccagtaggaatatcgccaacaatatcattgactgatatatcaacatattttatatcttccatagctataaaatgcgttgaaacatctttgttgacgtatataacctttagttcttctgggttttcacctgcaagctcgatgttttctccaataggggtgttctgtgcatttcctgtaataacagaaaccattgtgcataatgcaataaaaatctttctcatattattgttctttatctttgttgtttactaaaaaaacttgtgtgttatattttaatttggctttgttttttttgatgtttttggaaagagcttgggttgtactacggtaggcatcttgtaaagcacctaaagcgaattgttctactccttctgattggctgttcatttgtatagtttggcttcctatttgcgctccaacatctttactcaaatctctaaaagctgatgaaggaacaaagaaaccttcttgtccgtcattatcatatacagataaatctactttcatttgtctgccatcaaccattatagaggaaatattaatgtgtactctttgagctttaaagccagatacattcccatataggtaagtgcctttagttaaaagagcgtcattaatcattatatcatctagaagccgtatgcgtactcggctaccatctgttacttttaaagtttcatctaatatagctgtgattagtgaagttttttgttctttccctacagtattaaaatatacttctgcgggatttttcgcttttacaacttctatagccttttcttttggcttttcatcttgttttttttgaggtgttctaggacgtggattttgtaatgaatctatataagccatttgcattttaaaaagctccatttcttcttgcatcttggatttttcaggagctttcctagtttctgtttgacttgattcatctatagtaggaaatccttttatttgttgttccaattccttttctcggattctagaagcttgatttaaactgtcaatttgccttatttcatcattggagtaaagagaaccagaactttcaatttcgctaacttcttcttctttatctatggtttgtattgatgaataatcagaagatttattgaaagctcctttgagtgattcaaatttactttttatctctcttttttctaaattagcatcaggaatatcaagatttaattcttccgtttctactaatgtagtttcttctgctggggcagagtttatcatatccttaactagccatcctatccctagaataaaaggtaggatgagtatcggaatgatgtacttaggctttttaatatcaatctgtttcatacgctatttatttaatttattgtataaattttttattcgtatagtgtcttctggagttaatttcccattttttcttagctcattaatttcattttgcattttaatcacttctaacaagtcgtgaactcctacttgttttttttgtagggtactatcaatgttaatttgtactttgcttttttcttcgttgaaaacttgcattggctttctttctggacgcattactaatgatagaattgtgacgaaagaaaggaatgaaatcgtaattccaaacatagctttacggtgtatatcagcccacgccaataagcgttcacaagcgttattaactccgaacttttgaaatattttagtaagaagaacagctgtagcttgctcggctttagtcttgatactttcttttctatcattctttttatgtttaaacagtttcattagaaattcttttttactttataatctaggtctttgtttagtatcgttttccaatctgtgataataagtccatgaggattattttcagtgcgtggaatttgtcttaatttccctgtagttacaagttgcctttttagaatagaggtttctcgctctatacgttggatgccatagtactcaaaagataggttgttcatgtccaccttgatactatctgtcataattgttactgttgcagaactcgctaatatggtgttgaaatatcctttttcttttaaattattatattgttttaatccgctatcatcaattagatacatggctttttccatgttgtattttataaattcatcgtctggtggtaatgtgaaaaataaagtgtggaatagatttatgtggctcttacattcgacttccaagttgacttctgtaccagtttgttttactagtacagggacatcattatccaaaacatatattttttttctttcagcttttactaaagagaaacaaaaggctagtaccatacctgaaataactatactagttgcaaaacagccaatggataaaattccggctaatttgattttattttctaagtttttaataatcatgattatgtgaatttaaaatttaatgaatctttttacatagctgcactggctccacctgtagccggagctgctacagctttggttgcgatggctgctcctccaaccatgcctcctactgcttgccctactccagttgtacttacaatccatgtagaaacaaaaggtattgtaagcatggcaaatgctccaagtaatgctgtaagaaggaagctattgacacctccagaggtcattccgacatacatgacaaatgcagcttcatttctaagcgcatattctaaaatttcaatttctctttctatcccatattgcattactactaaagaaattgataatactatatatgcaatacatgaatataaactaacactgacaaaacgagctatccattgtatataagcatcccgaaatgcaggtaaaacagagaatgcaaaagctagtggaccaagaataactaatattcctgtgaatatgatttgtaggaaaaagacaaaataggtacatacttgccaaaaagtaacgacaataaattcaatgatattaaacattatcattttaaccttagcgactacatatacatataatccagctatcttgtctccaatagctgagaagtctatactaaaatcataccatttcttatccttaacttcattttcggctctttcaacttctaatgaagtatgtaataactctactgctacgctatcaatgagtgcatatctattacgagaaagtaattctacttcttctatctggttcgtaaacatagccttgcttcgtgctgttaataactctccgggataactgattagattaataaagggaatccagaacataagaaccaatcccagtgcgaatggacgcaataacgggataatctctaattttttatctccactcatcattttgaagctttctactccaaaatataacaacataaagattgctgccaatgcttgtgcatccgcaataaattctccgaatagaacagttgttttatctcttagtccatcaaataattcaaataagaatttatctattaactcattcatggctcattattgttttatttatattattcaatcttgttattaatgaaagaacctctattagttctttatcaaaatctaaataggcttccctttttttagagttactcatatgtgaatcatggattatatctatgttcttttttattctagtaacttcatcagttataacttcaacatgttctttattaccgccattagaagaatattcgacaagttttttatttatatcattaagaatatcatttctacgatttttagttaaagtatattgataatcaatttctttatctccaaatttgaagagttcctgtctatatatggtatcaacattatacccttctttttctgtttctgatttattgtactctacggctgccatcatgggaatttcttgtaactggaaattacgtctatcttccttcccgtatttgtcgtgtaaccctaagcccggcaaaggaattttaatacccaaaacctttttataccatatccagtaatgataccattctggttgtagtcgtactctatccataaattccatattattaagcacgctccatttccctttatcctttacaggcatttgggaataggtattagaagtaccaataatcaacattagggaaaaaaataaaagcactcttttcatattatcttttaggttttactttataattctgtaataaatcatcaactaattttgaacgattatctttgtatttaaatacccccggagctaatgtttgtaatactccatttctttttgctgttttcatctgtcggcatacagcgtatgctatacctctcatgtttcttagttcattaataacatacttaagcaagtctattctttgcttattatccataaggtttacatctgtcccgacaatagcgacctgataaatgtattgtgtcaaatccgcagtgcgatttactaattctagctctgtttttgctgacaccaataataaagccgggtcacctacagcaagttcaaccatttgtttttgatatttaccaatatctgctgcaatatcagtgcagtagataatatcttttcctgtttttatgatggcttctacagattttaggctattataaaatttgctttggaaaaattcaatctgaaccattttttcactgatttgtttttgtataaggcttatttgagcttcattctctttcactttagagaaagaagtatgttgcaccttatgattagctataagtgtttccatacaggttatatccaagactgccttttgcgaatatgcaacttgggttaaagtagatgctaccactaaaataaataggattttcttcatgatattatctttaacggtttgtaatccatttgtatttatctaggatatacttatataatggttgttcccctatgatgttaagtatatcttttaggcttccatcatcggagtgataccctagtaccttattgacttgtaaaacccaatccatattttttaatttggaagattttaggtctattataaaattatccaatcctgtttggaaactaccataaatgatatgataatatccaacagcatctttttcaattcgttctgtagtaaatgtgaaatattcgtgtagagaaacctctactccaaatacatttccataatttcctctttttataaatacttcattaaaccgattacggttttctttattgggaagttgatttatggtaaatatttgcttttgatttacttccgttagggataaaagatttgctatttcttgatatttgtctataaatttactttggtctaataggcatataatatcggagttgctgattatagagtttttgactacaggattactaattatgtcctccagttcttgagtaacaaccattgccataccccaaaatttacgaactgttttatacaaatagagtatatagccagccatcatagggctagctatggctttccatgcttcttcaattattaatgcctttctgttcttttttaatctcattttttgaataaaaacgtccataataattaaggttactattggaaataattcagggtcatctttaattgcatcaatttcaaaaactataaagggttcttcaaaaagggaagtgtcaaaatcctcattaagagttttttctaactgtcctcctttatagaatttttttaatagaaacttatagttagtaatatcaaaatcaattttgttctctttgcaaatgataggtataatgcgtagggaaaattcgtagaaagagttaaaagataagctttcaacttttatttctttcaatatatcttccttcttctggattcgtctttctattatagaaagtaatctagtttcaggattatcaagctcttggcgtgtaaagcctttttcgatgagaatgttttgtatcgctttttctgcgttggttttttctccgccttctcctttttctactagttgctgtaatttctctattttttcggaaagtatcttgcgttcttctttttccctttcgttttcaaattcttcttcattgacttgaaattcgagtagtaaattttcacgtatggcttctttttccgcatctgaataaccattaaagggatgaaagtagaaagaatagtatttttctatggtaatatccataatttcttcttcttgctttttgacctcaccatttgcacctttccatatcaggaaaattaatgatttaagaaagtttttcttttctacattatactcttcttcagtaattcggaaaggattcatagatataggcttgctttcagaataagtaatgtatttgccatgatagtattcgcacattcctgaataactatgccctgtatctaccaatacaatatcagtgttatctaaaacccattgtcttactttggagttgacatagaaagacttaccagaaccacttggacctaaaacaaagaagttggagttatttgtatattttttctcaccttctttcccggacatatctattccaacaggcaatccttgtctgtctgtaaaataagtaagaaaagggctgttttctgttacttgtaatttttccttgaacaaaagacaaattgcagcatcggaagttgttagaaatttgtcataactgtttaggttgattgcgtttcctggcagtgcacattcgaataattctaattggttgaaacattgtttattaataataatgccacaatcaaaaagagatgtttcaacatagttgatagccttactaatatcatcaagaccagcaagaattatattataatgtgcatatacaagcatttgcccttctctggcaatatccgactgcactcgttctatgtcttctacacataaatcatttgcagggtcaggcattcctttatgttttttctttttgccttctaatttgtttgcttcgtttcgttggtctggaatatttattacttgattatagataattgtgtctatacctggtgtatcatgcaaaaaagagagtaagtcaacaggaaaccttagcccaatattgacctctttatatggttttataacagaaggaaaattaacttcgtcaatatctacaagagaaatgcactgtacgtttttttctccaattataagattttcttctcttgctttgatattttttaggcttactgtttgctgattgaaattgatagatagaaatctttttatatatatttctatttcattttcatttaatagtttagctcttattcctctgttagcgaatagtcctaatacttttgtgatgtttctaataaaagtatcaaaccttcgagggtcaaaagaaaagaatttagacctttctacttctcctgtaataacaagataagtagaaatatcagtatatattcgtcctttaaaatgttcaaaataacgatttgataaatagtcgttcttcctattctggggtggtaaaaatgattttttacatagaatatcctgtttttgtattgtatatccagttcctaatactttgaggatattagtaaataagtggtgaaaatcatagtaagcatccatatctgctgaatactgtattataggattttcacatttaatgataacagaatagtcgccccttcggttatagaatataggagtattgtctattgtttcaataccaatataaggagcttcaaattcacttttctttttcataagctttatttttttctatctcttataaaagtgcgtgatactatatatatgccttttcgtttatctttcctgtgaagcccttttctttgtaattgcgatgttattcctaaccctccaaacataactattacaagagttatacctccccacataaaagaagccagagtagaaacaatagcacataaaagtaaagcactaataatacaagctccaccgatatatatgaacttgcctttaaatcctttgaaaataaggggcttttgtagccccttatatacattgtaacttggatactctttcgacatattagattccgaagaatgcttttacgacaacacctgatacaaccagaaagatacatgaccccatccagcccataacagccttttgtacatcttggtcaccagagttccattttaaataaactcgcactgctccaactaatcctactagacctcctagtatcatcatcatgtttcctagggggtccatgtaggttgcaagttcagaactagctgcatcaattcccgcagcaccttgtgcaaaagtgttagttactaccattatgctaatggctaaagcgaatgctctttgagcaatttttgaaaaaaactttttcatttgaataaaaattagttgtttatttgttaaaatttacgtgtgaaaacatgcttttccctttagcaagaagttgttccattggaataccttgtgtttcaacttccatttcaatagattcatttacagatacataattctgttcagattcttttttttcatcctctttttcgtatgagcctgtttcaaaatcttcatctacaactttgtgaggtatttcttcttcctctcctattgaaataatctcttcttcttcacctgtattggttttgctttgctttaggaaagcatcatacaggatgtttgcagcgtagtaaactacataaatggcaaatacagccatgataaattgtgaataactcatattcttaaatttaaaagtttcattaatcgaccctttttctgtacttttgatttataatagtactagaggtaataacaggggaaaaagccctagtttaaaatagtttcgcgaatagttgaatttatgaaacttggatttaaataaaatggagataataggctacgctcgtgtttcaacgagggaacagaatttagatttgcagctagatgctttaaaagaagccggatgcaaacttatatttgaggaaaaagtatcaggagtaaaggatagacccgaattagataaagcccttgcatatttgcgagaaggtgatacttttgttatctggaagctagatagattaggacgttctttgaaagatttagtttatatagttgattgtttgcagaaaagaaaagttgcattcaaaagcatagttgatggtattgatactaatagtgctctaggaagatgtcaatttggaatttttgcttcattggctgaatatgaacgtgaaataatagtagaacgaactagggctggattacaagctgcaaaagaacgagggaaacttacgggacgacctatagggttatcggaagatgcaaagagaaaagctatagcagcaaagcgtttatatgaaaatcgggattattctatagatgaaatatgtagaattttacacattggaagtaaggctactttgtataggtatttacgttatgaaaaagtaagattgatgaatagaagaaataaatagggcgttacctttcaggtcgggcttttcgctgcaagtcctcgctacgctgtgggctttccgctgcaatccctaacgcattttcccacccacccttctaaggtatatccaatgctttgcttttttcaccgcttctatgaagcacctacaaaagcaaggcattggatattcggttttatagacttcatgttccctaaagggaatattccgtttataaaaccttatctctcacccaaaatatataaaactttagggaaaagataatacgttaaaaatcagccagttataaactatttttaacaaaaataattgtcttattatttgcgacatttatagaaaattactatctttgagtattgaaaataaagagataaataaactttaaagctggtttggctgccagtataaagaacagcaaacaaaattatgaaatctacttttgataaaaatgcagagaagtttgtaaaccttatggttgaaaaaattgaaagtttgtctatgaattggcaaaaaccttggttctctaaagtcaactctaaacagaactttttaccacaaaatttaacaggtcgtacttatagtggtggaaacgcttttttactttattttttgtgtgaaaaatataattatcaaactcctgtttttttgacattcaatcaagcacgaaacgaaggtattaatgttctaaaaggtgctgttgcttttcctgtttattatacattattttgtgcttatcatcgtcagacaaatgaaaaaatttcatatgatgaatataacaaattatcggaagaagaacaaaaagaataccgtttagcagcttatacaaaatatttccaagtttttaatttagaccaaacaaactttgcggaaaaatatcccaatagatgggatatattaaaggctaaattttcaggagaggaacagccacaagaagagaaagaaatgtatgtaaatccaatacttgatgaaatgaataagaatcaaaattgggtatgtcctattcaaacggtttctagtgatagtgcgttttattcaatatcaaatgatagcattactttacctttaaagagccaatttaaggacggagaaagtttttatggtacagaattacatgaaatgggacatagtacaggtgttaaaaatagactaaatcgaaaaggattttatgaaaatgataaattcaattatgggcgtgaagaacttgtagcagaattaatatcggctttgtctggtgtatatttgggtatttctgtaaccgtcagagaagaaaatgcggcttatttaaaatcatggtgcaaagcaataaaagaagaacctaaatttttataggaactcgcatttgaaaacccctaaatcttcagtttaggggatgaaaaatgcggggtagcgcagctacccttggttttcgatgtattttttgatggtttcctgactgacatttccgactgatgacacaaaatatccatccgtccaaaatgtgttttcccagtaaaatacatgtctaaggtaattttcatgtcttttccaaatggcagttgttgacatttgttttagcctccttacgatttgcagcggagagagttttggttcgctgcatatcatcatgtgaatatggtctttgtcggtttccatgacctcaatgttaaagtctgacaggtctgatatgttctgcatgatttgcttcatgtcatattccactgctccaatgagtagcttcttcctgtatttgcatacaaatatcacgtgatatttgatgagaaacttcgagtggttctttgaaatgtaatctttctgtatcatggtctcattttaaatcgttacttttgccatatgttacgtgcctacaaatatagaatctatccgacagatgagcagaaggttttgtttgcaaagaccttcggctgctgccgttttgtctataattgggcattgaacctgaaaatcacagcctacaaggaacgcaaggaaacgctcggcaacgtatacttgaccaatttgatgaagagcgagctgaaggtggagcatgagtggctttctgaagtcaactcccagtccttgcagagttccttgcgtaatcttgatacagcctataccaatttctttcgcaacaccaaggctgtcggtttcccacgcttcaagagccgcaaggacaagcagagcttcctttgcccacagcattgccgtgtggattttgaaaaaggaacaatcacaatccccaaagcgaaagatattcctgccgtgctgcaccgcaggttcaagggtacggtgaagactgtcactatcagcatgaccccttcggaaagatactttgcttccgttctggtggacacgtccatgcaaggaatgaagccttccgaaccgatgcgtgacacgaccgtcggcattgacttgggcatcaagtcgcttgccgtatgttctgacggacgcacgtttgccaatcccaagaacttgcagagaagcttagaccgcttgaagttgctacaaaagcggttgagccgcaaacagaaaggttctgccaaccgcaacaaggcacgcatccgtgtagcccggctacaggaacacatagctaacagccgtaagaacagccttcacaaaatcacccatgcactcacgcacgacagccaagtgcgcactatctgcatggaagatttgaacgtgaaagggatgcagcgtaaccaccatttggcacaagccgtaggagatgcttctttcggtatgttcctaactttgcttgaatacaagtgcagttggtatggcgtgaacctcattaagatagaccgctttgccccaagttcgaagacctgcggcaaatgcggctatgtgtacaaagaattgaatcttagcgagcgcagttggacatgcccggaatgtggtacacatcacgaccgggacttcaatgccgcttgcaacatcaaggaatttggcttgaaagccctacccacggagcgtgggaaagtcaagcctgtggactgtcctcttgtggatgaccgacctcgtgtcctaaaaagcaatggcaggaagaagcaggaaaagagaggaggtattggtatctccgaagccgctaaatctttagtttagcggtagttcacttactgtattggcagatgctattaaaggtagtaaattcatagcccagcatctaaatataaggctagatgtggaagaagttgaagaagagaaaaatacaaaggttgcttaaaggttccttccccccttattggggggggagttcttttttcaaacgccaaaaaagaaccaaaaaggcttaatcgcttcactttgttacgctccaatagttttgctatcggtaaacccacccacccttctaaggtatgtttctttatcccttctgcaatccttagtaaagttccactaccttttaggtaactccactttagtaagcattgcagaagcggaaacatgacgcaaattaaaatacattctcactttgagaatacattttaatgcgtcttgttgtctaacccaataagaactatagggaaagaaattgataccgtacttttcggagttccggcactgatgggcaaacatggcatgatgaaatgataccgaattatcattcctggcacaccctacagaacaaccttttgataccaaatacaaaaagctgccggaagccggacgcaaagaattgataccataaaacattaggggaaaagaacaggaacagaataccatattatatatataaataatatatgaatatataatatataaataaacaatatataatatgtgattaatatactccacttccagaaagagcaacacgaagaatcttcttttccctaaagttccttgtgtcgtttctctctatacctgaatacaggaaaacggctgcatcataaaagaaaagacaccgacaccattcaggaactgccgcccatcggcaaaaggattgtacctaattgataccttttctatcagcactggagagaaaccgggaaggtatttgataccgtacttttccgggttctgcccggcatggacgataagagaacattattatgataccaaaaaactttagggaaaaataaaacttcggcactctataagcctaaaactatttttaacaaaaataattgtcctattatttgcgacatttatagaaaatcactatctttgagtattgaaaataaagagataaacaaacctttaaagctggtttggctgccagtataaagaacagcaaacaaaatcatgaaacattgcttcttaaatccatttcgtagccaactgttagggctatttttcagtattaattcattaatcatttttttatgaaaaaagagtttacattacgcttagacgatgcagcctgtgcggagttagaaaatctaaaaaaattatctggtgaaaaaacagatgctaaagctattagatttgctattcagaattatgcaactttgaatgataggtatattgaaacacaacggcaaataagaacgtggaaagataaatatgcagcgttaaataaagctgttgatgattacttgtcttcttttgaagcattgaagaaaactacagattgatagttaattattagaaatgtgaaaggattaacaaatataggggtaaattagaaattaacgtataactgtatataaataaacgaattatgaatgaaagaacaatccaaatagacgtaattggaaaaatagaaggtactcaatttatgaagtgtaagctatatacaaatgaaaatattgtcattatcatgatgaatgaatttgattatgaacggttgaaagaagaaggaatcttcataagagatggcaaaagtcgagattcagccggggtgttgaatacaaccaatactttcatcgaaaaaaattaatactcaaaacaaaaaagaatgattatggataaaaaagaaaagaattttgccacatacaaagaatttgcaaagatgcttcgggaagtggcaaacatatactctaaactgggtgacgaaccattgttgaaagaaggatatgagtataacgccattagagatgctgttcagtatgtaacgaacaaacacgattttgattactttatacagccttggaaggatgagtttctacgtatgccttttgatgtgacgaagcgaaaaaaatgggctgattatgtggctgaatgccatgctacaggaaaggaaatagattacgataattatgattgggataaatgaccataatttttcgaatagtgtgaaagggaatagatgtcatataatcaaaatatagatagaatgtttattgaatataaggtatatcgtagggtgtcagatttgaagccttttatatctagggttgaacttccttcttgtcagatgattgggaaaaaaaagtttgtaggaaaaaaagcaaaaatggaggctgtttatagacttacagggaaacgtttgccagaagactatacaacagagcaggtaaacaattttcttacggtagaattttttaatacgtctttatggcataagtatagaaagatttacaatgaagtttccaatgaaaaagaaattgttgttgagaactatagttatcaatatacattagttgtagaattagcaaataaatcgaatttatcattggatgaaggaaaaattgtacattttgttatgtgcgaactgttaggaaatccttgtgaaacgtataaagggatgaaaaaccctataatttctttacgaaaagattatgatagataaagcaaaaacattagatgaatgctttaaggaactaattcttaaaagaggttggtctaaaaatagtccatatgaccgccgaactgcatcaaggcataaaaagcaattccttgaaggaacgttgcccgatgaatttaaaagagtatatttgcaaagtgctggttatacaatagtgcagccggagctttggcgacaggaattataaaacaaagaaaatggactggaggaacataataagaaatctattagaaattatcattgctatttttagaatgattttcatagggctattttatatagccaagtttatgtttgtgttctttattctacttttttttggagtattaatcagtcaaaataataaacgatggtaaatagagaaataaaagcccgaaaacgtgcggtgaaagaagaaaaagaagaaatagacggtgagattgttagaattaggaaagggcatcctcgtacaaatcttcctgtgaaactcccagaaaatcccacatggctgaaacaacctaatgtagttacattaatggctggtgattttaagacagtacagattagaatcttaattgctgttatagagaaattacaggatgtcatagaattaagtattcagcatctagataaatatggtacatctattccatgcgagcaattatctttatttcaagaatattcagaccgtataagagtagatatcgcatatcgggatttgggcgttaatccagaccaatacaaggaagtaaaaagcatggttcgtaaattaatcagtattcctgtagagcttgatgttaaagacccaataacaggtgaggatagttggtctattactggtttattcactaaggcaaatatacctaaaactccttattcaagaggtttttctttagaaatggatagagaggttgctaaagttttcattaatgttgatagaggttttacacgctatataaaagagatagctttaagagcgcaaagtagatatacaataagaatgtatatgctgattagctcatggaaagaaaaaggtggtttttctatttatgtggatagatttcggaaattcttaaaattagaagataaataccccgaatttaaagatttgtataaacgtgtaatacgccctgtttacgatgatttgtttgaacaggctgattgctggtttgaaatggcagaagtttatcgtaattcaggcgatacacagccttataaacttaatttcaaagttattaagtctgcattatcaaagaaggaagaagaactattaaaaggacaaaagaagatgataacgaatttttgttctttgcactttgcaatgaaggacgaacatttgcagcagtttattccacagattacattaagcaactataaagcagtagtaactaagatgctttatctaggcgaatatgttagagataactggaataaaatttcaaataaagcagaatattgtttatccgtattattaaaagaagtagaaatactccccggaatgattggagaagaaaaagaagatgaataaaagttgggtttttgtccctaggaggggtctaaaagttgggtttttgtccctaagaagttgggtttttgtccctaagaagttgggtttttgtccctaagaagttgggtttttgtccctgattttttaccattatctgttgtttttcaaatagttacccttccatttttaagggtactaccatcactagctgataaaaaaaacctgataatcataccaaatacaaaaaaggaacttttcttattacataaacccataaaaaaggaacttttctcataatcttaacacgaactttagggaaaagaacatctattaacaaaaaaagacgctatatgatacaactaatcaatcaaaagttgggtttttgtccctatctaaaaaaaccatattttaaaaagttgggtttttgtccctatgcttttttgatatactgtagggaaagaaattgataccgaattatcattcctggtacaccctgcagaacgcctttttgataccaaatacaaaaagcagtcggaagccggacgcaaaaaattgataccataaaacattagggaaaaagaacaggaacaaaataccatattatatatataaataatatatgaatatataatatatgaacctataaacatataatatatgattaatatactccacttccagaaagagcaacacgaagaatcttcttttccctaaagttctttgtgtcgtttctctctatatctgaatacagaaaaacggctgcatcataaaagaaacgataccgacaccattcaggaactatcgcccatcagcaaaaggattgcatctaattgataccttttctgcctgcactggagagaaaccgggaaggtatttgataccgtacttttccgggttctgcccggcatggacgataagagaacattattatgatcaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgtttactataattgataattgatgacgttatgatatatagtacaaagcataataaaaatacaaatgaagatcctaaaacatctgttatttttgagaatctgatgttattaccagacgatcttttttgggaaattctaagagaatcaacccctaatggtaaaatattacctaatgatgctggatatttacttcatagtgatgattatttttggcctcattggaattctaaaggtaattatgatgctgggaatctaaattttgtagaaccagatgttttttttcgcttttctaatttcgatataatcgtagaagccaaattatcagattgttcaggccagaattatgaggaatgggaacgagaatttaaatcttatctcaacgaatacggagaagagaaaaaaacagtatatttatttgctgtaggtggtaatagtatattaaatattgaggaaccactgattgttgatgggtataaatgtccaattgtaaaatttacttggtttggtatattaaatcaggtttataaaagatgggaagaatttgataatagaaactatcaagaatcttcaataaagagaatcttaaaaaatgttatagaaggttttaatcttatgggagtttatatttataataataaaataaatctaaaagagtttacaagtatacaatctttaattagagcttttgatatagtacaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgtatagtagttaaattatcaacagataaattcgaattaataccatttggaagaaaagatattacagatcaatattatggagttaaatttcaattactagctaaaggtaaagatgatatatatttatctttagggatttggtttaaagatggacttattactgttgggttaaataatagagatggttgggcacgaaagttttgtgaactaatagagcaaaacaaatctcttaattctgtgtattcaaaattagaaacaacagaatatgatcctgataaatttttatattttgaaccaactaataagtttaatgaagaatttgcacaaaaagaaacatttgatgggcaggtagatttattatttctttttgttaaagaagtttgtatgaactatatagagtaatatttgatttatctttttacagaatgttcattgtcataattttctttttgaccaacttcccactcacgtttctctccatggcttccaccaccaaagtcacgcaatttacttttaccaaagagaagtgcagtatgtctcttgttttgtaaatgcttatgttgccctgatttcttaacaggctgttttatatatttctttaaccgttcaaggctgcaattctcttcagtaagatttataatgatgtgttgcttgaagttgatggcataagttgcatcctcatcctgacggatggtgaagccctcttcatgcaatcggcttctgacggaggaaacattttcgtcattgaatacctcacgcagacggtttacagtatcagtgtagtagtgtgttcttttccggggtagtgtttcattcagtgtgtctgaaatgagtcttcagatcttttagttttgcaaatatatcactttatttgatacattatcggcaggtaggcatgccgataatgatttttattcgtccggaaacagattcttttcaagatcaattcttggaacctgtctcaggtaagacttcttgtccatggcagtctttcccataagcaggatgacagactcctcgttgggcattgcaccacgcatcctcgtaactcgccggaagtccttctgcaggcgttctatccagttcgtagtatatatcatagattggatgcggtggtcatagttcaggtaagtgaaatatgccttgtaggaagcatcctcaccacgtttcctgatactcctataataccggccccattgggcacagaattgctgccattcactccaggcctgttctactgtatagtttctgtcccctgtccggaaaatatgcctcaaatcttctgccacatctcctttgtccccgttacggacatcgctcaagatattgcgctttaggtgggtagtgcatctctgaagtttagttcctgggaacacttcactgatgacatcttcaagtcctttaagaccgtccgcgcatataagaccgattttaccgacacctctctcgtacaggtcatgcagcatctcaccccagcccaaagcactttctgtcggtttgttgaagataccgagtacctccctggtcttgtcctccttcacggacagaacgacatagaaggcttccgtatcaacgctacgcttgcggtgtacctttatgtgtacgcagtcaatgaacaccacaggataatagctttccagagaacgttccagccagtctgtgacatccttgcgcaggtagtcaagcatccgcgatatactggctttgctgtagtgctcgccatagatgtcgttgaagacttcaccaacctgttcctgagtcagacctttggtgtacaaggtcccggcaagtcgtttacactcttcttcctgatcacggagtatggccaatatacggggatgaaagttaccgtacctgtcacgtggaatacggaaagtcaatgtacgtccatacccatatgtacgaccaggacggtagccattgcacttgttgcctgaaacaccctcttcatgaagatattccctgcgctctgatatcatcaggctttcaagcattatttccatcaaatcatgtaagccattttctttttccgaatgcttgcatatcagctcggaaagttgttcctttgtgaaatccataaagtctactctttttttaggtttattggtttgctgctacaattctaaaaaatctgtagacttttttattatcctatttcagacacactttttggaacagtatcacaggttttcatgattatagctcctgactccaccaatagtcaaattgagcctgtttcctgcgatatcctcatggattgaaggtatctcaaaacaaaacatcattctctcatagtaaatggtcttatcttcttccaaaaaatcttttactgacttgtgaatagtttcgggaattctccctttgatgatatgacttactctgatttcaggcagttcaatactttcacttgggaaaaccctgttagctgcttctcatacagattcaataaagttgggatgggagatggttatttcattgtccttgctgaatacaggtacaatgcaatcatcttttagatgttcaatagtgacttcctttgtgttagcctcaataaaagagagttttttacttctcttcctgacaagatggattctacatcaacaatttcttgtttagacaaatcaaatgtcctgttttaccctgcttggataaatcaagttagccttgaaggctgtagttgcattgcttccacatcttatgaaatttggattatagttaatactcggtttattcttatcctcttgtagttgaattttcttctgcataaaatcagagatcaattgttgataacattcaggatatttatgataaatggcggtcactttctctatagttttagtcgtatttatttgctgttttatcatttcaacagtcactccatcaattgcaccaatcaaggataatttgtcctgttgttggtgtaatggtaaagtcgggctttcccataaacaggttagtcctatccttgcttgcaatggcttgatgcttcatgttgatgtcaaagactatagtaaattcatagtttattccatctctcattacagctttaaaccctactttttcaggcacgattttgccattcttctcattcaatacatagttctgtgtgcacctcatagtgcaaatgatatgcttctcactttgcaatatattctgcataaaagcattaatttttggagtaactttctgccaattagtgaaactattacttcgcaaattggcatgatactccaacagattatcccagcattgggaaatggaatctatgataattacttctattcctgcatcctcacatatcccaatggcttccatataggtttcaggagtaaaattgtcttgaagagaaagaacattataactgcctaagtgagcatataaatcagcactttcattttcactatctataattgctattttactccaatctccacacaacccataggtaagaaataaggcagagtaagttttaccactgcctgcacatccttgaagagcaagttttattttggcttgcttctttgatgaaactcttaacagcatcatattaaaaatgaaatatctactgcattcaatctttcactatagttcttaatcaaattggagccataggaaagaatctcagggtctttaatttctccttttcttaacttagaagcaattatcactttatctgttttgatatatcctacttttctactatgagtgattctaacaatacttcggtaaatttttaccgataaattaaaattaaacatagaatcggcataatccggttcaaaattatattcaagagatcattgaaatactgtcaagaataaatcgtcaaggagtaagaaaagggatgaaaaagatatgctaaacagctgaaaatcaacagaaaaagtatttcataattcactgatttttagtaaattagaagtacttcaccacttttaattatgactaaagaatcactccttatgcaataccaatccgagtgcagaaacgctctcgaatcagctgtaaatataagcaaatcttttcagaaagtattcatggatgcaatgaaattattcatggctatacctgaccgcatcaatttcctacaaatgggacggtatggatgtttctcggaacagacataccgcaacaattttgagaacgacggctttgactggttttccttcaatgaagccatcatcagggaacaccttaaaggtggtcgcaaggcgatagccgttgatccgtctttcattccaaaatcaggcagcaaaacgccgtggattggctatttctggtccggttgtgccggtgaatacaaacgtggactggaaataaccggtattggagttatagacgttgacaaccatgaatgtatgactttgggctctgtacagacacctgacaacgcaacgctggaaagctgtgagaagaatcttgttgactggtacagctcttaccttatcagcatacaggaacagctgaaacgtatttctggcacagtcgtgtgtgatgcgttcttttcaaaggcaactttcatcaaaccattgtacgataacggtttccacgtaataagccgtttcaggaatgatgccgtattgttttatcccaccttagaaaataggacaggaaaacgcggacgtccaaaattacatgacgagaaaattgactttgaaaatctggacatcacaagatgtaccgagtacaaagtgaacaagggtaaactttacggactgaaagcatactccaaagcactcaaacgctttgtgagcctggctgtatggtaccccatggatggaagaacggacaaatggcagctgtatttctctacaaacgaaatacagaacgcacaggatgtcctggacttttacagaacacgtttccaactcgaattctgctttcgggatgccaagcaacatgccggaatagcaaactgtcagtctacagacttcaggaaactggcattccactttaatgcatcacttgcagcgataaacctcgccaaggctgcctgtaagaagatgggaataaaatattccatatcatcatgcaagtcagtcatacacaatgcttacatgcttgaacgatttatttgcgtgtctgggattgaaccaaacacgcaattaattgacaaacttttcaaagaactcattttatttactgccagagccgcttaggctgggctaatttttaacgaactattgattctaatgtaaataggaaataatttatcatttctctgttgtctaacacagattttaaaacttgccatatataactaataatcaatattatacgaatattattttagtgtaaacattctcttaatttagtgtaaacatgaagtaaacactactacatgaaaatcagaaaaataaagtaatataacatagaaaaagggacttgctgtaataaacaagccccttaacttattaattattagtaaatatctgtttttcttctttagagtttattcctcaatagcagcctgcgccataccgatatagatttaatattcaaatacttaactgcatcgtgtaagcctacagtaagcgaatatttatctaatattgttttgattaatgattcccagcttagaggatatcctcaatagcggcttgtgccttgtcaattcctttctgattattagacgtttaccatacaagtgtaagcctatagtaagcaaactttcttgataacttattgaccggaattttctcacttaatcaaatatggtcgtaagtgactgaatcttaatacgctagaacttacatggtaagtgtaagcggcattcactttacttttgcctctccatcaaccctttgatgaataattaaatattaatagatatacaacatttcagtttattcttttctcctatctttcaatagttcaataattacgtccttatccttcaggtttgaatcaagacgtaaaatctgtgagttcagactctctatctgttccttcagaagcttgattgtttccctcaggttttctgtttctttcttttcgctggataactgcacggccagttccgcatcacctatcaggttgtttgcatttccatccaatgaaacggctgcaaggtgtgccgatatatgatgctgtctcggacagaaaagggaaaagaaattgaagtccaatgcttcgctgactttaataagcctgcacgtttccattgtctccctttccagtatgcggtttatgtgctgctgcggtacacctattttgcgcccaagctcagatttgcttaatccaagctcgttgcgtcttttgtcgatagcctgacctacatgcacgtgttttatgtcattatccatgcgattccttcaataaatatatcttaaacaataaatcatcaaacaaatatttggttatataaaccattttatgttactttgtggtgtaacatattcatttggtgaatacaaagttaaacattaaatattaaacatccaacaattatgtctgaaaacttagaaaaaatccgtccggcacttgttgcccttgaagtaggtgaatcagtttcattccctatttcacgtttgaaaagcgtccgtacacaggcctcagagcttggtgccatctacaaccgtcagttcaagaccaggactgatagggaaacccaaaccattacggtcaaacgaacagtatagaaaccaaatcaggtttatatgaagatattacagtttctggaccatcttataccatacgaaacattcctgaatgacctctcctccagaattgtcaggcaattgaaagccgacaaggatgatcctgaattcatcagccagaggaaggcatacgagctgtttggccgcaggaatgtagaaaggtggaaacgtcagggaaaggtggtttcctataaaagacccggtaaggtggaataccgcacagcagacctcaggcttctccagcgtaccacccaggactattttgatgaaagtcagccgaaacaggcagaaaaaccggtcaagaaagataaatgataaacatattatggctaatacactaatattgataaactttatttgtttagtttagccgtgatactctatgaaatataaagaaagcaattatagtaggtacaggaatgtgcgtcagtaacctttgttcgccagcttatagtttaaaataaagccggacaggtcttttttatcgcacattcataatgattttataataatgaaagaaatcagaccagcgtgcgatccaaacggtgtctattcagtcaagcgcacctgtgctgaactcggtatcagcaacaagacactcaaaaaatacagagaaaacgggtatatccaaccgctcaatcctaataatatcagccgtccgaaatactccggccagtcaataatcgattgttggaacctgctcagtacgttatgataagcgaaacaaccatacggaaagtaagggaacttgccatagaagacgtactcagtccttatgtcagactgtccagaaaaggctcaaccctgatggggctttgtccttttcattccgaaaagaccggttcctttgccgttaccccaagcaagaatctcttccactgtttcagctgtaaccgtggcggtgattccattacgtttataatggaaaaggaaaacctttccttcagttccgctgtggaatttattgccagaaaccataatattccggtagaatacatcagtgaagagcgcagtgaggaacagatggccgaagccaagcaccgggagtcacttctgacagttctcgatacagtacagtctttcttcctgcaaaatttaagagcaacagacaaggaagagagccttgatgccagagcctacgcatacggccggtggcatgaggagttctgtgcctttgccggaataggctatgcaccgaaggacggtcaggcctttatggatttctgcagaagcaaggctctgaacgaagaactgctgtacgaactcggcatgttcaagcgtggtgaggacggaaacacatacgccatgttccgacagcgtatcatgattcccgtgagaaacagatggggacgcatcattgcctatacagccagatacatcggagacaacaggaaagctcccaagtatatcaactcggcaacaagcatgatttactccaagggagaaacagtattcggtattgaccgtgcagccagactgcgtgatgccgactattatatcattgtggaaggtgctcctgatgtcctgagaatgcagtcgattggatacgacaatacagtagcgtcacttggaacaacttggagtgacagccagttcgagcagctgaagaagtatgtatcctcactctgtttcattccagattcagatattgcggaaggcaagccatacggacctggatttgaggcggtgatgaccaatggggctgcagccataagaaaaggattccatgtaacagtcagggaacttccttttgcagaaataccatccgaggcagaaggaaaagtacaatatgccaagaatgatgccgacagctatatccgcagcagggaagattatacttcacttccggaaaagcattttatcatctggttggcacagaaacgttttctggtagccggttccatggtagaggaaagaaagtgtgttgcggaaatagcagacctgttgcgctatataaaagaccagcttgtgtatgaccagtgtatagaacaactctccagactgcacggcaaggtaaagctatggcgtgatgccgttacccaggcacgtggggaagccaggagaaggaacgacaaacctgcggccatgaacgagatgcagcgtgaagctgaactgctgcgccagttcggtctgttcgtcagggaaaactgttactactccatcggtgaagatgatgatgaaccgtcaagaatctccaacttcataatggaaccactgttccatatcgaggatgagataaacggaaccagaatcttccgtatgaggaatatgtacaatgtatgcagggtcatagaactgaaggagtctgaattatgctcgctgagcaacttccaacagaaggttggttcactgggcaattatgtatggctggccaagatagacaaactcaaccgtgtaaaggaatacctgtactcaaagaccgatacggcagaacgtatcagaaaactcggctggaatgcagctgaaggattctttgcttttggaaacggaatattttttgcaggcacattcaatgctgttgacgaattgggtatagtccgttgtatcaacggcaaggccttctatataccggccacttcaaaaatctatctcaacaatccggagatattccagtttgaaagacttatggtgcatgagaaccgtaacggaataaaactgtatgattacgtaaaaagacttatggaagtattcggtgagaatgcaagtgtagccttctgttaccttcttgccaccctcttccgtgacatcatattcagacgtacccgccactttcccatcctgaaccttttcggtgagaaaggaactggtaagacaaccctggctacttccctccagtcctttttcctgcacggagtagatccgcccaaccttggagtaacctctgtaccggccatgaacgaccgtgtgtcacaggccgtcaatactcttgccgtgcttgatgaatacaagaacgacctcgacatacgcaagatagcctatctgaaaggactctggggcggtggcggccagaccaaaaagaatacgaatacagacgggatggcagcacagaccattgtcacaacaggtgtagccctttgcggccaggacaagccgacacaggatatggcactctatacccgtgtcatcttccttgccttttcaaagacatcattcaaccagaatgagaaaagggcttatgaagaccttgtatcagtctgcaacatgggacttacccatctcactctggagatactgggacaccgggaactgtttgagaagaattttccggaaatatattccatcaccaagcgtgagctggctgcgaaattggataatgaaaccatccatgaccgtattttcgggaactgggttattccactggccaccttcagaacactggagactgtcattgacgtgcctttcagctatgcagaattgtttgatacggcagtcagaggaatacgaaatcagaatgaactggctcaggaaagttcagagatagcggacttctggagtatgcttcagggattccagacttcagggaaatgtattgagaaggcacattaccgtataaggtatatgaaatccttccgtccattgtctgtaaaagaagatatagaatttaaagaagcacgtcctattctctatctgaacacggcagccgttgcatcactgttcaacagccggaacgcaggttccacctccaatcgctcgaattggtccaccatcatgtcctacctgaaatcccatgcttcatacctgggactgaagcaggacagattcaccatacttctgccaagcggacttcctgactataccattgacattgtgaatggagagcaggttaagaaggtaaaagtaaaccgtccgaaggcattatgctttgattatctccagctgaaggagactttcggactggatcttgaaactgaggttgtcgctgaagtacaggacatgaaggaagaaatgacttccggacacaaacaatatcctgagcagaaaggcttattttaattgagaatttacaataataaattatcatcagaaaaatccaatccttttaaatgtattcgtcaagcaattatttacagttatcttttggattttcaaaacttaactcttatttttgtagaaatcttgcaaaaaaaggagttaagtttatgattttagagttttgtgtcagtaattacttgtcaataaaggatgagttaaaaatatcctttgttgcaactgctcttaaagatgttcttaccgagtcaaatgatatgataactgtacccgataccggattatttgtattacggagtgcagtgatttatggtgcaaacgcttcaggaaaatcaaatgttctaaaggctattgctttttacaggcgttttatcacggactctttcaaaaacagtcaggccggagaagcaattgatgtagagaacttccggttgaataccacttcaatggatgagccgactacaatggaggcaacctttattgttgaaggtttcacttaccgttatggttttgaggttgacagcaaagctgtacgtgccgaatggctgtaccagcgcacaaataaaaagagagccaaagaagttgaaatattctacaggacagaagaagaaaccactgttcatcagaaaagttctttattgatagagcttgtaaacaagaaaatggtgcgtgacaatgctttactgctgtctactggggcacaattcaatgagccgatagcagtcagtatcctgcaatggctgaatgatatgcatgtgatatttggcaatgatgaggaaagactgtggaaacaggctataaagtctatggatgatgagaatctccgtttgcgtattactaactttgcaaaatatgcagatctggggatagacagtatcgtaaaaacagataaccgtatcgttagtactcaccggcaatatgatgatgaggggaaagaaaccaatagtgtagctttttcattcagcagtaatgaatcggaaggtacaataaaatatttttctttgtcatatcctatcattgatgctttggataatggaaaacttcttgttattgatgaacttaattcaaagcttcatcctctgttggttcgtaaaatcatcggccttttcaattcggcaaaaacaaacccaaagggtgcacaactactttttacaactcatgataccttcttgttaagcgctggtatgtttcgccgtgaccagatatggtttacacagaaaaacagtttcggttctactgaagcgtattcactggttgaatataaagtacgcagcaatactccatttgaaagggattatctgctgggtaaatatggtgcaactcccattatcggtgaaatggagagggtctttaatatggaggaatgagtatgggaagacaaacaaaaaaggaccatcgttcaggcagtctgaccagaaagcagggaacgagaaatgtaaaacagtcttttctcatagtatgtgaaggggtacgtacagaaccagactactttaaggctttccgtatgacaactgccacagtcaaagctataggtcaggcaatgaatactataagtcttgtcaataaggcaatcagcatacgtgataccgaacaaaagaagaagcattactatgatcagtgttgggttgtttttgacaaggatgattttcctgcaaaggacttcaatcaagcaataattttggctcaaaagaacggtttccgtgttgcttacagtaaccaggcatttgagtattggtttctattgcattttaatctctatcgaggtcctctccatcgccagaattatgcagatatgctgtcaaaacttataggaatgccatattcaaaaagtgaaggatttggtactgtcatgtataataggctttatcacctgcaatcacaggcaataaagaacgcaaatgtagtacttaacgaggtttcaaatggaaatcctgccatggaagaatcttcgactactgtacatttattgattgaagaattgaataaatatgtttgatatagttggttgcattaagaataaaacatagttaaatgagagtttaataaaaggtaataactgtatttaagataattggtacataacataattaattgattgaaaaaatggaaataggtgatataataaaaggatatacaataaaagagtatattggagatggtggtatgggtattgtttttaaggttgagaaagatgggaaagaatatgctttaaaaatatgtaacacaacagatgatgagtatgtctcaagatttaagagagagatacgaatgatggaaacaataaacaataatagaatagtaaaaattattgataaagatattgatgcttcaattccttattttataatggagttatgtgatgaatcgcttgaaaatgctgttgaaagaggattgtccgaagagaaaaaatttgattatatattgcaattgtgtgatggattaaaagggctacatgatcaaggaataattcatagagatattaaacctggtaatgctcttattgttgatgacaaaataaaagtgtcagatttaggtcttgggaaatttattaaacgtgatactccttgtttgactcctactgatgataaatatatgggaacatacgattatatggctccagagatatatattgatggtaagggaagagatgcagataaacggagtgatatcttctctttaggaaaattattatattttatatttacagatcaatagttcgttaaaaattagcccagcctaagcggctctggcagtaaataaaatgagttctttgaaaagtttgtcaattaattgcgtgtttggttcaatcccagacacgcaaataaatcgttcaagcatgtaagcattgtgtatgactgacttgcatgatgatatggaatattttattcccatcttcttacaggcagccttggcgaggtttatcgctgcaagtgatgcattaaagtggaatgccagtttcctgaagtctgtagactgacagtttgctattccggcatgttgcttggcatcccgaaagcagaattcgagttggaaacgtgttctgtaaaagtccaggacatcctgtgcgttctgtatttcgtttgtagagaaatacagctgccatttgtccgttcttccatccatggggtaccatacagccaggctcacaaagcgtttgagtgctttggagtatgctttcagtccgtaaagtttacccttgttcactttgtactcggtacatcttgtgatgtccagattttcaaagtcaattttctcgtcatgtaattttggacgtccgcgttttcctgtcctattttctaaggtgggataaaacaatacggcatcattcctgaaacggcttattacgtggaaaccgttatcgtacaatggtttgatgaaagttgcctttgaaaagaacgcatcacacacgactgtgccagaaatacgtttcagctgttcctgtatgctgataaggtaagagctgtaccagtcaacaagattcttctcacagctttccagcgttgcgttgtcaggtgtctgtacagagcccaaagtcatacattcatggttgtcaacgtctataactccaataccggttatttccagtccacgtttgtattcaccggcacaaccggaccagaaatagccaatccacggcgttttgctgcctgattttggaatgaaagacggatcaacggctatcgccttgcgaccacctttaaggtgttccctgatgatggcttcattgaaggaaaaccagtcaaagccgtcgttctcaaaattgttgcggtatgtctgttccgagaaacatccataccgtcccatttgtaggaaattgatgcggtcaggtatagccatgaataatttcattgcatccatgaatactttctgaaaagatttgcttatatttacagctgattcgagagcgtttctgcactcggattggtattgcataaggagtgattctttagtcataattaaaagtggtgaagtacttctaatttactaaaaatcagtgaattatgaaatactttttctgttgattttcagctgtttagcatatctttttcatcccttttcttactccttgacgatttattcttgacagtatttcaatgatctcttgaatataattttgaaccggattatgccgattctatgtttaattttaatttatcggtaaaaatttaccgaagtattgatagatataatcccaggaagtaatcattcttttgaaaatatatctgttagctgccaattaaaagaaaaatttgagagtacaaaagcatcttcattatttttagtacttgatgtttcaggctctatggataatttatataaagctgggcatgtacataatatcgctgagcaagtgctatcagtttcgttgacaatatcagaatctaaagaaatttctttatggaagtttggtgatagagctgattttgttgaaaatatcggattagagaatattcagtctgttaaaaatgtacattgtgaaggtactggaactgaattaaatgctttcgtaaatgctgccagtggctcaataaatgatgggtctttagttattatatttactgatgacgatttagggtctataaagaaagctgctttgaatattaaaaataaaagcaaagtattttggcagataatcgtatatggggagcataagaatatttcatcagaaatatcgaattgttcaaatgtgtctttgatctgtatggatgattatgcttctaaaagtaagaaagaaattaatcaaatgttattgaatgattatattttatggaaaaataaataatacaaagataaaagtctaaatataactaatgtaagtataatacaaataatggttatatttagacttttgttctattttgtcttatatacagaaatgataggcctgaacttatgcgcttgatcttttggcgtttcctgaatagttcctgactgcatggaataaagccaagccttattttccttttgcccttctacctctgtagacgaccacaaccagcattcacccggattcagattaatcggagttccaccgacttcagttatacattcattaatctggtgccggacagcgaacagataagagagttgccggacagaaggaatataagccgattgtccataactccacaaatcaaaagacttgatagctattggtgataggacttcatcattattgaacaaagaataggtattctcatttccgtcctcatcagtcaatgatgcagaagtaccctggtcaataccaagactgtcggcaaaagccagtggttccatatcatgaatgtaaactgcataaccaagattgtcagcatcaggactacggtttacatggaaaactatgccaacagcttctttgtcagattgcttgaatttgtccatggacaatatatttccgtccgaacaaaccacattgccaacctgaagggaagataacagttcggtaacatcttcatgttcacaatgacaggaagtgagcaacagcccactccatgccagaatcggtaataaaaatctgttcagcttcataacagtgggatttcaaatgacctgattacacattgcgcttccttgtccataatgaaccagtattcagaacggtatggctgtccgtcagaatcagtagcttcatactctatctttaccttccaaccgttgaacggcttgcgttcctgcctggcttcatcacctgtaggcttcagttcttctgtaaccatcagagagcggagtgccgtcatggcatccatctgatgtttcatctgaccggatatcccgtgacattctgaatctggattatcaaaatctgtatcctccataaacctgcggctgattttcatcatggccacagaaagagccatcttctccttcatgctaacatactcacggccaaatacagaatccggtttgctgatacccacaatctttacggattccggattgtccaccgaagccatcagtgcctttttggccatatcctgtgccttattttcgctgttgccggaacagccggttcccattccgagcaggactgccactgcaggcagtatcagaagtttctttccctgtttcatatctttacgatttgaagtttgtccggggccagaccgagacgtttgcggtaaatggaaccgtcttcccggtacatctccagttcgtatgaagtaatgttcttctcacaaagttccttcgcctcttccagtgtcagctgatggcctcctatattcctccatatggcgaatgagcacggtgtttcctgattgctgtagttggaacagttgaaagcccttgttcccacacgtacctcgccgccgcagtgcggacacctgccgataacagactgcatattgaccgcaccgtcatcagcaagttccagcactgtcgggaatgtctttccttccttggtggaaaagccgtccagaaggatacggcgtttctctaaaaattcagcaatctccccgtcattcattttccggttgccgatgatggcattgatgttgagcacacaagaaggatgctcacctgtgttgttttcgcagcgatagcccttgcatgttttcaccacgttgccgccgcagaacgggcagcgtcctataatcttcttttctgaatccatattcctgataagttacattgtttgaattaattgaatgagaccccccggttccagtccgcaacgattcctcctatgatgttcttgccggacatcacgcttgcccaaccttccgggtcaagagagaaccagaggtcgttccatgagagtgtgcgtacctgccatgccaggataaagaggtcggtattgacagcctccagtctggtcagtacctcgtttgcaatgtagtaccgctcggaagaactgagcaggtttaccttgtgcttctccttgcctccgtcagaaccgcctgtatcatagcttccggaagtcaccagttgcttcatgaacggataaagcgcagccatctgggttgcggcatcagccagctcgtccgaaacgattgcagcgatggccgtccccttcaggttactgccgaccgatttgagcagcagactgcagttctggggtatctccgtggtcaccagttccccggcacgcttaatctgatagagattctgcatggcaccctgtgcattggaaagatattccagcagcttgttctccacactgtgtaccctgtcgagtgcaaccgttacggcagtctcggcagcaatgattttctcgtgtgccttctgacgtttgtcatagatattcttcagtgtggaagtctgtgcaaagacagcacccgtcagtgtagggtctgtctgttgtgcaaaagtgtctgtacctttcagcagaaaaaacgccaaagcagtcactaccgttattcttaacttgattctgtccatatcattcagattttacgccctttattcctttgttcgctcagattctgttcacgttcctctttgtgtggtgaaatcaccggctccatcggcctgttcagcagacagtcgttccagtccttgaaagccttcggaggaagccattgtcccatacggtaccggatgttcagctgcctggcaacctgggccagtaggggacgctccaagtcaggctcgaatacctttcccttcgcttcaatccggatgccgccgtcagtcctgcttatcttcatctgaataccttcctgcagagccatcatgcgcagtccgtatatcctcccggccaggtcgttgtcacaacagtcgaaggcacgtgcatttggaaagcgttccatgactccggttatctgcctgtcagaaaatgtgccgcccagtgaaaccagagccgcactgtccccaatctgtatccggttcatctggtagaaggccatagcatcaaatgcagattcaca
